(12) United States Patent
Sheikhnehjad et al.

(10) Patent No.: US 7,498,315 B2
(45) Date of Patent: Mar. 3, 2009

(54) METHODS AND COMPOSITIONS FOR THE INHIBITION OF GENE EXPRESSION

(75) Inventors: Gholamreza Sheikhnehjad, Saline, MI (US); Mina Patel Sooch, W. Bloomfield, MI (US); Neal Goodwin, Plainwell, MI (US); David Olson, Ann Arbor, MI (US)

(73) Assignee: ProNAI Therapeutics, Inc., Kalamazoo, MI (US)

( * ) Notice: Subject to any disclaimer, the term of this patent is extended or adjusted under 35 U.S.C. 154(b) by 381 days.

(21) Appl. No.: 10/858,145

(22) Filed: Jun. 1, 2004
(Under 37 CFR 1.47)

(65) Prior Publication Data
US 2006/0073596 A1    Apr. 6, 2006

(51) Int. Cl.
*A61K 31/70* (2006.01)
*A01N 43/04* (2006.01)
*C07H 21/02* (2006.01)
*C07H 21/04* (2006.01)

(52) U.S. Cl. ............. 514/44; 536/23.1; 536/24.1; 536/24.3; 536/24.5

(58) Field of Classification Search ............. None
See application file for complete search history.

(56) References Cited

U.S. PATENT DOCUMENTS

| | | | |
|---|---|---|---|
| 5,264,423 A | 11/1993 | Cohen et al. | |
| 5,286,717 A | 2/1994 | Cohen et al. | |
| 5,591,607 A | 1/1997 | Gryaznov et al. | |
| 5,705,188 A | 1/1998 | Junichi et al. | |
| 5,840,497 A | 11/1998 | Holliday | |
| 5,874,416 A | 2/1999 | Sheikhnejad | |
| 5,968,748 A * | 10/1999 | Bennett et al. | 435/6 |
| 6,177,274 B1 | 1/2001 | Park et al. | |
| 6,287,591 B1 | 9/2001 | Semple et al. | |
| 6,440,743 B1 | 8/2002 | Kabanov et al. | |
| 2004/0006036 A1 | 1/2004 | Hu et al. | |
| 2004/0241651 A1 * | 12/2004 | Olek et al. | 435/6 |
| 2005/0181037 A1 | 8/2005 | Ahmad et al. | |

FOREIGN PATENT DOCUMENTS

| WO | WO 94/17086 | 8/1994 |
|---|---|---|
| WO | WO 96/18732 | 6/1996 |
| WO | WO 97/14440 | 4/1997 |
| WO | WO 0177384 A2 * | 10/2001 |
| WO | WO 2004/050885 | 6/2004 |

OTHER PUBLICATIONS

Jen et al. Stem Cells, vol. 18, 2000, pp. 307-319.*
Opalinska et al. Nature Reviews Drug Discovery, 2002, vol. 1, pp. 503-514.*
Bocchetta et al. 2004, Oncogene, vol. 23, pp. 6484-6491.*
Morris et al. Clinical Cancer Research, 2002, vol. 8, pp. 679-683.*
Chirila et al. Biomaterials, vol. 23, 2002, pp. 321-342.*
Carbone, Giuseppina M., et al., "DNA binding and antigene activity of a daunomycin-conjugated triplex-forming oligonucleotide targeting the P2 promoter of the human *c-myc* gene," *Nucleic Acids Research*, vol. 32, No. 8, pp. 2396-2410 [2004].
Christman, Judith K., et al., "5- Methyl-2'-deoxycytidine in single-stranded DNA can act in cis to signal *de* novo DNA methylation", *Proc. Natl. Acad. Sci. USA*, vol. 92, pp. 7347-7351 [1995].
Harel-Bellan, Annick et al., "Specific Inhibition of c-*myc* Protein Biosynthesis using an Antisense Synthetic Deoxy-Oligonucleotide in Human T Lymphocytes", *The Journal of Immunology*, vol. 140, pp. 2431-2435 (1988).
Hyung-Gyoon, Kim, et al., "Inhibition of Transcription of the Human c-*myc* Protooncogene by Intermolecular Triplex", *Biochemistry*, vol. 37, pp. 2299-2304 [1998].
McGuffie, Eileen M., et al., "Antigene and Antiproliferative Effects of a c-*myc*-targeting Phosphorothioate Triple Helix-forming Oligonucleotide in Human Leukemia Cells", *Cancer Research*, vol. 60, pp. 3790-3799 [2000].
Tufarelli, Cristina, et al. "Transcription of antisense RNA leading to gene silencing and methylation as a novel cause of human genetic disease", *Nature Genetics*, vol. 34, No. 2, pp. 157-165 [2003].

* cited by examiner

*Primary Examiner*—Janet L. Epps-Ford
(74) *Attorney, Agent, or Firm*—Honigman Miller LLP; Jonathan P. O'Brien; Kelly T. Murphy

(57) ABSTRACT

The present invention relates to methods and compositions for the inhibition of gene expression. In particular, the present invention provides oligonucleotide-based therapeutics for the inhibition of oncogenes involved in cancers.

8 Claims, 50 Drawing Sheets

Figure 1
SEQ ID NO:1

```
ctcgagccct attaagtaag ccgctgtgct tctagaagac cttttctctt tcttggtgct ttttgtcaaa
gactcttgga gataaaaata cacacgtgca acttgtttgt ctccttgtcc tttttgcta gggctattc
atgctgatta atttaaaact gtctgcttgc gcgtacacac gtctgcgagt gtgaatgtgt atgtgtgtat
ctatgtacct catttgagaa agtgcggcca actaggattg gctacgaggc aaaggtggag acctttagga
gccaccacc cccagcgtta ggacggtggg cctgaaagtt actatatgga agtcctcatc gtgtagcact
aaaccagtgt aaaaggtgtt aggacagag gaaaacatt gacttaaact gtcgtaaagc cctgataaa
cccctttccc tggagctgct gagttctgca tggcctgggc acggactagg tgttcaggtg gacacgggcg
gggatgcgcg tgcgtgtgta gtgcgcggac acctaggaag ctacttgaaa gtaaacacca cgctcggggc
gtccctagac attgcttaaa acgtgcagag tcacctgtct tcacagcagg gcagcgctga ggtctcactg
ctgggggcgg tgggggggcg cattggcctg gtcttccgc gcgccgagcg ccggtaacac aacgtgtgtg
tgtgtagcgc gtgtacacac tctcatacac ggctagaaag acacacacac ggtccaggcg acacacacac tccacatac
acggccagaa aaggtccagg cgagacacac ttttccagcc acacacacac cttccgcccg gccggggcg cactcacacg
gccagaaagg gtccaggcgg ttggcggcgc ttttccagcc cactccgtcg tgcgattccc gccgggcgcg tcttttcatg
gcgcaccctc ccgccagccg ccccctccg cactccgtcg tgcgattccg cgggagcccc caccccgtcg
cggaccccag cgaccaccaa gtcgcaccgg cctccgcagg cctgagcaga aggcccgcg cacacccacg
cgcggggccag gcggggagc ctgtgccgcc cgcgccacc actggccgg cccgcgggc gcagcggagc
gggcgggtgg ccggcccgga ggcgccctcc ccggccgc cccgccgc atgtgccccc ggcgggacgg
ccactcccgg gcctgccgcg gcgccttaa cccggccag ggagcgggg ggaggggcg gtcggggtgg
ctcagaggag ggctcttttct ttcttcttt tttgaatgaa ccgtgtgacg ttacgcacag gaaaccggtc
gggctgtgca gagaatgaag taagaggaca ggcaccacag cccgctccc gccccttcc tccc
```

Figure 2
Exemplary bcl-2 Antigenes

- *Bl1  168-190*
- 5'- ACTXG CAGAX GTGTG TAXGX GCA -3' (SEQ ID NO:2)
- *Bl2  483-506***
- 5'- CAXGC AXGXG CATCC CXGCC XGTG -3' (SEQ ID NO:3)
- *Bl3  666-685*
- 5'- ACXGG XGCTX GGXGX GXGGA -3' (SEQ ID NO:4)
- *Bl4  883-902*
- 5'- GAXGX GCXGG GCXGG GXGGA -3' (SEQ ID NO:5)
- *Bl5  1035-1056*
- 5'- CCXGX GXGTG GGTGT GXGXG GG -3'(SEQ ID NO:6)
- *Bl6  1102-1127*
- 5'- CCXGC CXGCT CXGCT GXGCC XGXGG G -3'(SEQ ID NO:7)
- *Bl7  1150-1170*
- 5'- GGXGX GXGGG GCXGG GCXGG G -3' (SEQ ID NO:8)
- *Bl8  1148-1174*
- 5'- ACATG GXGXG XGGGG CXGGG CXGGG GA-3' (SEQ ID NO:9)

Figure 2 (cont.)

- *NBL1 1-24*
- 5'- GCGG CTTACTTAAT AGGGCTCGAG -3' (SEQ ID NO:10)
- *NBL2 232-259*
- 5'- CCTCGTAGCCAATCCTAGTTGGCCGCAC -3' (SEQ ID NO:11)
- *NBL3 291-314*
- 5'- CAGGCCCACCGTCCTAACGCTGGG -3' (SEQ ID NO:12)
- *NBL4 546-570*
- 5'- GTCTAGGGAC GCCCCGAGCGTGGTG -3' (SEQ ID NO:13)
- *NBL5 614-649*
- 5'- CGCCCCCCA CCGCCCCCAG CAGTGAGACCTCAGCGC -3' (SEQ ID NO:14)
- *NBL6 707-732*
- 5'- CCGTGTATGAGAGTGTGTACACGCGC -3' (SEQ ID NO:15)
- *NBL7 839-870*
- 5'- GCGCCGCCAA CCGCCTGGAC CCTTTCTGGCCG -3' (SEQ ID NO:16)

Figure 2 (cont.)

- *NBL8 921-954*
- 5'- CGCA CGACGGAGTG CGGAGGGGGG CGGCTGGGCGG -3' (SEQ ID NO:17)
- *NBL9 961-983*
- 5'- CCG CGACGGGGTG GGGGCTCCCG -3' (SEQ NO:18)
- *NBL10 991-1017*
- 5'- CCG CGACGGGGTG GGGGCTCCCG -3' (SEQ ID NO:19)
- *NBL11 1057-1098*
- 5'- CGGGCCAGTGGGTGGGCGGGGGCACAG GCCTCCCCGCGGGGC -3' (SEQ ID NO:20)
- *NBL12 1180-1214*
- 5'- GCGCCGCGGGCAGGCCCGGGAGTGG CCGTCCCGCCG -3' (SEQ ID NO:21)
- *NBL13 1223-1258*
- 5'- ACCCCGAC CGCCCCCTCC GCCCCGCTCC CTGGCCCG -3' (SEQ ID NO:22)
- *NBL14 1301-1334*
- 5'- GCCCGACCGGTTTCCTGTGCCGTAA CGTCACACGG -3' (SEQ ID NO: 23)

Figure 2 (cont.)

- *NBL15 91-120*
- 5'- GGACAAGAGG ACAAACAAGT TGCACGTGTG -3' (SEQ ID NO: 24)
- *NBL16 328-357*
- 5'- CTGGTTT AGTGCTACAC GATGAGGACT TCC -3' (SEQ ID NO: 25)
- *NBL17 401-432*
- 5'- CA GGGAAAGGGG TTTATCAAGG GCTTTACGAC -3' (SEQ ID NO: 26)
- *NBL18 452-480*
- 5'- CACCTGAACA CCTAGTCCGT GCCCAGGCC -3' (SEQ ID NO: 27)
- *NBL19 1131-1149*
- 5'- GAGGGCGCC TCCGGGCCGG -3' (SEQ ID NO: 28)

Figure 3
SEQ ID NO:29

```
1   cccgggggtc ctggaagcca caaggtaaac acaacacatc cccctccttg actatcaatt
61  ttactagagg atgtggtggg aaaaccatta tttgatatta aaacaaatag gcttggdatg
121 gagtaggatg caagctccca ggaaagttta agataaaacc tgagacttaa aagggtgtta
181 agagtggcag cctagggaat ttatcccgga ctccggggga ggggcagag tcaccagcct
241 ctgcatttag ggattctccg aggaaaagtg tgagaacggc tgcaggcaac ccagcttccc
301 ggcgctagga gggacgcacc caggcctgcg cgaagagagg gagaaagtga agctgggagt
361 tgccactccc agacttgttg gaatgcagtt ggaggggggcg agctgggagc gcgcttgctc
421 ccaatcacag gagaaggagg aggtggagga ggaggctgc ttgaggaagt ataagaatga
481 agttgtgaag ctgagattcc cctccattgg accggagaa accagggagc ccccccggg
```

Figure 4

- <u>HR1 393-416</u>
5'-AAGXG XGCTC CCAGC TXGCC CCCT-3' (SEQ ID NO:30)
- <u>HR2 298-322</u>
5'-TGGGT GXGTC CCTCC TAGXG CXGGG-3' (SEQ ID NO:31)
- <u>HR3 310-334</u>
5'-TTXGC XGCAG GCCTG GGTGX GTCCC T-3' (SEQ ID NO:32)
- <u>HR4 300-332</u>
5'-XGXGC AGGCC TGGGT GXGTC CCTCC TAGXG CXG-3' (SEQ ID NO:33)
- <u>HR5 257-281</u>
5'-AGCXG TTCTC ACACT TTTCC TXGGA-3' (SEQ ID NO:34)
- <u>HR6 204-227</u>
5'-TGCCC CCTCC CCXGG AGTCX GGGA-3' (SEQ ID NO:35)
- <u>HR11 393-425</u>
5'-ATTGG GAGCA AGXGX GCTCC CAGCT XGCCC CCT-3' (SEQ ID NO:36)
- <u>HR23 299-333</u>
5'-TXGXG CAGGC CTGGG TGXGT CCCTC CTAGX GCXGG-3' (SEQ ID NO:37)
- <u>HR23* 299-333</u>
5'-TXGXG CAGGC CTGGG TXGT CCCTC CTAGX GCXGG-3' (SEQ ID NO:38)

Figure 4 (cont.)

- *HR-New1 1-21*
- 5'-G TGGCT TCCAG GACCC CCGGG-3' (SEQ ID NO:39)
- *HR6 204-227*
- 5'-TGCCC CCTCC CCXGG AGTCX GGGA-3' (SEQ ID NO:40)
- *HR11 394-425*
- 5'-ATTGG GAGCA AGXGX GCTCC CAGCT XGCCC CCT-3' (SEQ ID NO:41)
- *HR23 299-333*
- 5'-TXGXG CAGGC CTGGG TGXGT CCCTC CTAGX GCXGG-3' (SEQ ID NO:42)
- *HR23-New 18-mer 299-317*
- 5'-TXGXG CAGGC CTGGG TXGT CCCTC CTAGX GCXGG-3' (SEQ ID NO:43)
- *HR23* 299-333*
- 5'-GXGT CCCTC CTAGX GCXGG -3' (SEQ ID NO:44)
- *HR-New2 511-539*
- 5'-CCCG GGGGG GCTCC CTGGT TTCTC CGGTC-3' (SEQ ID NO:45)

Figure 5
SEQ ID NO:46

```
  1 cctgagggtg gcggggtgct cttcgcagct tctctgtgga gaccggtcag cggggcggcg
 61 tggccgctcg cggcgtctcc ctgtggcatc cgcacagccc gccgcggtcc ggtcccgctc
121 cgggtcagaa ttggcggctg cgggacagc cttgcggcta ggcaggggc gggccgccgc
181 gtgggtccgg cagtccctcc tcccgccaag gcgccgccca gacccgctct ccagcggcc
241 cggctcgcca ccctagaccg cccagcccac gcccctcc gccggcccgg ccccgctcc
301 tccccgccg gcccggcccc gcccctcct tctccccgcc ggcgtcgct gcctccccct
361 cttccctctt cccacaccgc cctcagccgc tccctctcgt acgcccgtct gaagaagaat
421 cgagcgcgga acgcatcgat agctctgccc tctgcggccg cccggcccg aactcatcgg
481 tgtgctcgga gctcgatttt cctaggccgg ggccgcggcg gcggaggcag cagcggcggc
541 ggcagtggcg gcggcgaagg tggcggcggc tcggccagta ctccccggcc ccgccatttc
601 ggactgggag cgagcgcggc gcaggcactg aaggcggcgg cggggccaga ggctcagcgg
661 ctcccaggtg cgggagagag gtacggagcg gaccacccct cctgggcccc tgcccggg
```

Figure 6

- *Kr1 102-124*
- 5' - CCXGG AGXGG GACXG GACXG XGG -3' (SEQ ID NO:47)
- *Kr2 168-191*
- 5' - GCXGG ACCCA XGXGG XGGCC XGCC -3' (SEQ ID NO:48)
- *Kr3 505-527*
- 5' - CCTCX GCXGC XGXGG CXGCX GCC -3' (SEQ ID NO:49)
- *Kr4 532-558*
- 5' - TTXGC XGCXG CCACT GCXGC XGCXG CT -3' (SEQ ID NO:50)
- *Kr5 547-574*
- 5' - CXGAG CXGCX GCCAC CTTXG CXGCX GC -3' (SEQ ID NO:51)
- *Kr6 598-623*
- 5'- TGXGX GXGCT XGCTC CCAGT CXGAA -3' (SEQ ID NO:52)
- *Kr7 40-67*
- 5' - GCGGC CACGC CGCCC CGCTG ACCGG TCT -3' (SEQ ID NO:53)

Figure 6 (cont.)

- *NKr1 11-39*
5'- CCACAGAGA AGCTGCGAAG AGCACCCCGC -3' (SEQ ID NO:54)

- *NKr2 69-102*
5'- GC GGGCTGTGCG GATGCCACAG GGAGACGCCGCG -3' (SEQ ID NO:55)

- *NKr3 133-158*
5'- GCCGCAAGGCT GTCCCCGCAGCCCGCC -3' (SEQ ID NO:56)

- *NKr4 203-227*
5'- GCGGGTCTGGGCGCCCTTGGCGG -3' (SEQ ID NO:57)

- *NKr5 234-260*
5'- CGGTCTAGGG TGGCGAGCCCGGC -3' (SEQ ID NO:58)

- *NKr6 280-312*
5'- GC CGGCGGGGGA GGAGCGGGGG CCGGGCCCGGGCG -3' (SEQ ID NO:59)

- *NKr7 313-349*
5'- GCGAGCGCC GGCGGGGGAGA AGGAGGGGGC CGGGCCGG -3' (SEQ ID NO:60)

Figure 6 (cont.)

- <u>NKr8 421-443</u>
- 5' - GCT ATCGATGCGT TCCGGCTCG -3' (SEQ ID NO:61)
- <u>NKr9 454-495</u>
- 5' - CGAGC TCCGAGCACA CCGATGAGTT CGGGGCCGGG CGGCCGC -3' (SEQ ID NO:62)
- <u>NKr10 377-409</u>
- 5' - GACGGGGCGT ACGAGAGGGA GCGGCTGAGG GCGG -3' (SEQ ID NO:63)
- <u>NKr11 630-660</u>
- 5' - CCGCTGAGCC TCTGGCCCCG CCGCCGCCTT C -3' (SEQ ID NO:64)
- <u>NKr12 670-690</u>
- 5' - CGCTCCGTAC CTCTCTCCCG C -3' (SEQ ID NO:65)

Figure 7
SEQ ID NO:66

```
ggatcccagc ctttcccag  cccgtagcc  cgggacctcc  gcggtgggcg  gcgccgcgct  gccggcgcag  ggagggcctc  tggtgcaccg  gcaccgctga
gtcggttct  ctcgcggcc  tgttcccggg  agagcccggg  gccctgctcg  gagatgccgc  cccgggcccc  cagacaccgg  ctccctggcc  ttcctcgagc
aaccccgagc tcggctccgg tctccagcca agcccaacccc cgagaggccg cggccctact ggctccgcct cccgcgttgc tcccggaagc cccgcccgac
cgcggctcct  gacagacggg  ccgctcagcc  aacccggggtg  gggcgggggcc  cgatggcgcg  cagccagcgc  taggccgcgc  ctggcagacg  gacgggcgcg
gggcgggggcg  tgcgcaggcc  cgcccgagtc  tccgccgccg  gtgcccaacccc  cccgcaaccc  gagccgcacc  cgccgcggac  ggagcccatg  cgcggggcga
accgcgcgcc  cccgccccg   gcctcccgcc  ccagggggca  gtcgcgcctg  tgaacggtga  gtgcgggcag  ggatcggccg
ggccgcgcgc  cctcctcgcc  agcaatacgc  gcggggggcgc  cgggggggcgc  ggcgtaagcg  ggcgggcccg  gcgcggccgg  cgcgggtgg
gtgggccgg  gcgggggccg  cggcacagg  tgagcggggcg  tcgggggctg  cgcggggccg  cgcgggcccg  ggggccccttc ctccctgggg  tccggcccc
acccgtggcc  tcgcctggg   cacgtcccc   acgccgccgt  accccggagc  ctcgggccc   gcgccctcac  accccggggggc gtctgggagg  aggcggccgc
ggccacggca  cgcccgggca  ccccgggattc agcatcacag gtcgcggacc aggccgggg   cctcagcccc  agtgccttt   ccctctccgg  gtctcccgcg
cgcttctcg   gcccttcct   gtcgctcagt  ccctgcttcc  caggagctcc  tctgtcttct  ccagcttcct  gtggctgaaa  gatgccccccg  gttcccccgcc
ggggtgcgg   ggcgctgccc  ggtctgccc   tccccctcggc ggcgcctagt  acgcagtagg  cgctcagcaa  atacttgtcg  gaggcaccag  cgccgcgggg
cctgcaggct  ggcactagcc  tgcccgggca  cgccggggcg  cgctccgccg  tggtccagag  cgtctctgag  gacgtgaac   tcagccctcg  ggcgcttccc
tttagccttt  ctgccgaccc  agcagcttct  aaatttgggtg  cgtggttgag  agcgctcagc  tgtcagccct  gccttgagg   gctgggtccc  ttttccccatc
actgggtcat  taagagcaag  tggggggcgag  gcgacacgc   tccccgcacgc  tggttgcag   ctgcacaggt  aggcacgctg  cagtccttgc  tgcctggcgt
tggggcccag  ggaccgctgt  gggtttgccc  ttcagatggc  cctgccagca  gctgccctgt  ggggcctggg  gctgggcctg  ggcctggctg  agcagggcca
tccttggcag  gtggggcagg  agaccctgta  ggaggacccc  gggccgcagg  ccctgagga   gcgatgacgg  aatataagct  ggtggtggtg  ggcgccggcg
gtgtgggcaa  gagtgcgctg  accatccagc  tgatccagaa
```

Figure 8

- *RZ1X\*\* 485-510*
- 5'-GGXGX GXGGT TXGCC CXGXG CATGG G-3' (SEQ ID NO:67)
- *rz1 485-510*
- 5'-GGCGC GCGGT TCGCC CCGCG CATGG G-3' (SEQ ID NO:68)
- *rz4x 1641-1672*
- 5'-TTCXG TCATX GCTCC TCAGG GGCCT GXGGC CC-3' (SEQ ID NO:69)
- *rzx\*\* 388-415*
- 5'-GXGCA XGCCC XGCCC XGXGC CXGTC XGT - 3' (SEQ ID NO:70)
- *rz2x\*\* 501-533*
- 5'-GGXGG GGXGG GGGGX GXGXG GT - 3' (SEQ ID NO:71)
- *rz3x 1271-1290*
- 5'-GGGAG GXGCC XGAGG GCTGA GGTTA CXGTC-3' (SEQ ID NO:72)
- *erz1x\*\* 481-510*
- 5'-CGGGG GCGGG GGXGX GXGGT TXGCC CXGXG CATGG GCTCC-3' (SEQ ID NO:73)
- *srz1x 491-510*
- 5'-GGXGX GXGGT TXGCC CXGXG-3' (SEQ ID NO:74)
- *rz5x 333-361*
- 5'-GXGXG CCATX GGGCC CXGCC CCACC CXGG-3' (SEQ ID NO:75)

Figure 8 (cont.)

- <u>rz6x** 665-696</u>
- 5'- CXGCX GCXGC XGCXG CXGCT TAXGC CXGCX GG- 3' (SEQ ID NO:76)
- <u>rz7x 1224-1251</u>
- 5'- AXGGX GGAGX GXGCC AXGGX GTGCC XGG -3' (SEQ ID NO:77)
- <u>rz8x 1421-1451</u>
- 5'- AGXGT GXGGG AGGGC TGTXG CCTCG CCCCC A-3' (SEQ ID NO:78)
- <u>RZ4X(New) 1639-1672</u>
- 5'- CXGTC ATXGC TCCTC AGGGG CCTGX GGCCX GG -3' (SEQ ID NO:79)
- <u>RZ9X** 733-760</u>
- 5'- CXGCC XGCXG CAGCC CCXGA XGCCX GCT -3' (SEQ ID NO:80)
- <u>RZ10X** 333-361</u>
- 5'- GXGXG CCATX GGGCC CXGCC CCACC CXGG -3' (SEQ ID NO:81)
- <u>LRZ1X 485-539</u>
- 5'- GGCXG AGGCX GGGGX GGGGG GXGGGX GGGGG GXGXG XGGTT XGCCC XGXGC ATGGG -3' (SEQ ID NO:82)
- <u>RZ1uX 468-500</u>
- 5'- TXGCC CXGXG CATGG GCTCX GTCXG XGGXG GGT -3' (SEQ ID NO:83)
- <u>RZ11X 442-467</u>
- 5'- GXGGC TXGGG TTGXG GGXGC AGGGC A -3' (SEQ ID NO:84)

Figure 8 (cont.)

- *Nras-1 31-68*
- 5'-GCGCCGGC AGCGGGGCGC CGCCCACCGC GGAGGTCCCG -3' (SEQ ID NO:85)
- *N-ras-2 85-117*
- 5'-CGGCGAG AGAACCCGAC TCAGCGGTGC CGGTGC -3' (SEQ ID NO:86)
- *Nras-3 127-160*
- 5'-GCGGGCATCTC CGAGCAGGGC CCCGGGCTCT CCCG -3' (SEQ ID NO:87)
- *Nras-4 196-220*
- 5'-CCGGAGCCGA GCTCGGGGTT GCTCG - 3' (SEQ ID NO:88)
- *Nras-5 241-268*
- 5'-GCGGAGCC AGTAGGGCCG CGGCCTCTCG - 3' (SEQ ID NO:89)
- *Nras-6 273-294*
- 5'-CGGG GCTTCCGGGA GCAACGCG -3' (SEQ ID NO:90)
- *Nras-7 297-323*
- 5'-CGG CCCGTCTGTC AGGAGCCGCG GTCG -3' (SEQ ID NO:91)
- *Nras-8 418-441*
- 5'-C GGGGGGGGA GACTCGGGGCG GGC -3' (SEQ ID NO:92)
- *Nras-9 540-577*
- 5'-CCGTTCA CAGGCCGGAC TGCCCCCGGG GCCAGGGCCG G -3'(SEQ ID NO:93)

Figure 8 (cont.)

- Nras-10 595-618
- 5'- CGAGGAGG GCGCGCGGGCC CGGCCG - 3' (SEQ ID NO:94)
- Nras-11 781-815
- 5'- CGCGA GGCCACGGGT GGGGCCCGGA TTCCCGCAGG -3'(SEQ ID NO:95)
- Nras-12 820-845
- 5'- CGGGT ACGCCGGGCGT GGGGACCGTG C -3' (SEQ ID NO:96)
- Nras-13 851-881
- 5'- C GCCCCCGGGT GTGAGGGCGC CGGGCCCGAG -3' (SEQ ID NO:97)
- Nras-14 892-916
- 5'- CGGGCG TGCCGTGGCC GCGCCGCC -3' (SEQ ID NO:98)
- Nras-15 981-1010
- 5'- CGAGAAGCGG CGCGGGAGAC CCGGAGAGGG -3' (SEQ ID NO:99)
- Nras-16 1088-1115
- 5'- GCGCC CCGCACCCCC GGCGGGGAAC CGG -3' (SEQ ID NO:100)
- Nras-17 1120-1154
- 5'- GCGT ACTAGGCGCC GCCGAGGGGA GGGCAGACCC G -3' (SEQ ID NO:101)
- Nras-18 1160-1197
- 5'- CGGGGCG CTGGTGCCTC CGACAAGTAT TTGCTGAGCG C -3'(SEQ ID NO:102)

Figure 8 (cont.)

- Nras-19 161-185
- 5'- GGGAG CCGGTGTCTG GGGGCCCGGG -3' (SEQ ID NO:103)
- Nras-20 363-387
- 5'- CTGCCAG GCGCGGCCTA CCATTGGC -3' (SEQ ID NO:104)
- Nras-21 706-729
- 5'- CTGTGCCCG CGGGCCCCGC CCGGC -3' (SEQ ID NO:105)
- Nras-22 918-956
- 5'- CGGCCT GGTCCGCGAC CTGTGATGCT GAATCGGGGGG TGC -3' (SEQ ID NO:106)
- Nras-23 1691-1720
- 5'- CAGGGCACTC TTGCCCACAC CGCCGGGCGCC -3' (SEQ ID NO:107)

Figure 9
SEQ ID NO:108

```
   1 ctgcagcctg gtacgcgcgt ggctggcggt gggcgcgcag tggttctcgg tgtggagggc
  61 agctgttccc cctgcgatga tttatactca caggacaagg atgcgatttg tcaaacacta
 121 cgaggagtag cagagaaagg gagagggttt gaaagggagc aaaagaaaat ggtaggcgcg
 181 cgtagttaat tcatgcggct ctcttactct gttacatcc tagaggtaga gtgctcggct
 241 gcccggctga gtctcctccc caccttcccc accctcccca ccctcccat aagcgccctc
 301 ccgggttccc aaagcagagg gcgtggggga aaagaaaaaa gatcctctct cgctaatctc
 361 cgccgaccgg cccttatataa tgcgagggtc tggacggctg aggacccccg agctgtgctg
 421 ctcgcggccg ccaccgcgg cccggccgt ctttggctcc cctcctgcct cgagaagggc
 481 agggcttctc agaggcttgg cgggaaaaag aacggaggga gggatcgctc tgagtataaa
 541 agccgatttt cggggcttta tctaactcgc tgtagtaatt ttaccgagag gcagagggag
 601 cgagcgggcg gccgcctagg gtggaagagc cgggcgagta gagttgcact tgggaaggga
 661 gatccggagc gaatcggggg cttcgcctct ggcccagccc tcccgctgat cccccaggca
 721 gtggtccgca atccttgccg cattcacgaa aatttggcca taacacgggg cggtcacttt
 781 acactggaac gtccaacacc cgagcaagga cgcgagtctc ccgancgcga ggagactatt
 841 gagatgtgtc gattgctac ataggtgtc ttttctccca ctcctgcgcc atcgacagtt
 901 ttctcagaat acctttggta agtggggctg gggtgggcgt tatttcagaa ctgtatcggg
 961 caaattgtat tcctcaccgc caccctcccgc ggcttcttaa gggcgccagg gccgctttcg
1021 attcctctgc cgctgcgggg ccgacgttcg ggactgagca ctgcgcgctg cgccaggttt
1081 ccgcaccaag acccctttaa ctcaagactg cctcccgctt tgtgtgcccc gctccagcag
```

Figure 10

- *cm1 423-449*
- 5'-XGGCX GGGGC CXGX GGTGG XGGCX GXG-3' (SEQ ID NO:109)
- *cm2 175-199*
- 5'-GCXGC ATGA ATTAA CTAXG XGXGC C-3' (SEQ ID NO:110)
- *cm3\*\* 349-371*
- 5'-GCXGG TGGGX GGAGA GATTAG XGAG-3' (SEQ ID NO:111)
- *cm4\*\* 501-529*
- 5'-AGXGA TCCCT CCCTC XGTTC TTTTT CCXG-3' (SEQ ID NO:112)
- *cm5 47-77*
- 5'- TXGCA GGGGG AACAG CTGCC CTCCA CACXG A -3' (SEQ ID NO:113)
- *cm6 13-39*
- 5'- TGXGX GCCCA CXGCC AGCC AXGXG XGT -3' (SEQ ID NO:114)
- *cm7*
- 5'- GGGXG CCTXG CTAAG GCTGG GGAAA GGGCX GXGC -3' (SEQ ID NO:115)

Figure 10 (cont.)

- *Ncm1 101-130*
5'- CTACTCCTCG TAGTGTTTGA CAAATCGCAT -3' (SEQ ID NO:116)

- *Ncm2 225-251*
5'-C TCAGCCGGGC AGCCGAGCAC TCTACC -3' (SEQ ID NO:117)

- *Ncm3 293-326*
5'-CCACGC CCTCTGCTTT GGGAACCCGG GAGGGCGC -3' (SEQ ID NO:118)

- *Ncm4 542-569*
5'-CGAGTTAGA TAAAGCCCCG AAAATCGGC -3' (SEQ ID NO:119)

- *Ncm5 600-632*
5'- CG GCTCTTCCAC CCTAGGCGGC CGCCCGCTCG C -3' (SEQ ID NO:120)

- *Ncm6 664-687*
5'- GGCGAAG CCCCCGATTC GCTCCGG -3' (SEQ ID NO:121)

- *Ncm7 800-836*
5'- GTCTCC TCGCGNTCGG GAGACTCGCG TCCTTGCTCG G -3'(SEQ ID NO:122)

Figure 10 (cont.)

- <u>Ncm8 957-993</u>
5'-GCC GGGGAGGTG GCGGTGAGGA ATACAATTTG CCCG -3' (SEQ ID NO:123)
- <u>Ncm9 1011-1046</u>
5'-CGTCGG CCCCGCAGCG GCAGAGGAAT CGAAAGCGGC -3' (SEQ ID NO:124)
- <u>Ncm10 1061-1090</u>
5'-CTTGGTGCGG AAACCTGGCG CAGCGCGCAG -3' (SEQ ID NO:125)
- <u>Ncm11 396-420</u>
5'-CAGCACAGCT CGGGGGTCCT CAGCC-3' (SEQ ID NO:126)
- <u>Ncm12 721-748</u>
5'-CGTGAATG CGGCAAGGAT TGCGGACCAC-3' (SEQ ID NO:127)
- <u>Ncm13 758-777</u>
5'-GTGACCG CCCCGTGTTA TGG-3' (SEQ ID NO:128)
- <u>Ncm14 875-896</u>
5'-GTCGAT GGCGCAGGAG TGGGAG-3' (SEQ ID NO:129)
- <u>Ncm15 1110-1140</u>
5'- CTGCTGGAGC GGGGCACACA AAGCGGGAGG C-3' (SEQ ID NO:130)

Figure 11
SEQ ID NO:131

```
gagctccggg tacctggaga acatgaatct ccgggtgta ctgtcccat gagggtcacc gaggaaccta tggatctttcc
actcttcgcc cagaatgtct tccctctatc ccctccacct cccaaattc cagcaccagg ggccaccttca gagccacaaa
tcctgaaagg accacccagg tgactcgggc ccacacaccc ctcttttcggg gtacacttgg tgcaggcta ggagctttg
gcctcagctg gtggtgccac acaccagatt cgtcacagag acccattttt tatcagtccc aggccagaag tacgaagact
gatcttaacg atgtggcctg cctgggaggt aaggcggcag gcgttgcaga attgatggga actgtggcac aggtgggaaa
cctggttaa caaattcttc attgattcag gggaccactt tccttgagcc aagtcttggc aagcggccgg cgaaactcac
aggtccctt cctggctgcg tcccagcct ccagccttcc ccgccccaga gatgcccag gagcgccccc tcggtgtagg
taacgggtgc ccgggcggct ccgtccgccg cctagagcct gaagcccgcc actgcgccc cgggggtggt gtctgaagtc ggctacgcgg
ccggcgccga cccgccgg tggagtccgc tgccgcactc gcgccgccag gctctgggat cccaccctc cccaggtcgc cccgccagc agccgcgcc
tgcctttcg tcggcccggg tgcccggctc ccccgccct taccccaaac gccgagtggc gaggaggtga tgtgccctca cggtagccgc gccctccgc agcgcccgcc cccatcgggg
ctgctcggtg cgctcagcgt cgctcagcgt cccgccccct taccccaaac gccgagtggc gaggaggtga cggtagccgc gccctccgc gccctgcct ttcctatttt ccgcccggcg agccccgcc
cggagggg gggtcagctg tgcccggtc gccagcagag aggcgctcgg tcctcccctcc gccctccgc gccctccgc gccaggtag ggcaggaggc ccatcggg
ggcagcgctg cggggcgctg gccagcagag aggcgctcgg tcctcccctc gccctccgc gccaggtag ggcaggaggc tggagagcct
agtctgcgtc tttccccc gcaccgcgg gccgctccgc cactcggca cgcaggcctg ttcgctctgg gtattgtgtt ggctgcgtgc
gctgcccgcc cgcccgtaaa atggtccct cggctggaca gctcgccctg gctcgccctg cgcccgtggc tgcagcagtg gtgtcccatt ttaatgactg
caggccttgg agaacagcac gtcccgctg agtcagacc cgcccgtggc tgcagcagtg gtgtcccatt ttaatgactg
cccagattcc cacactcagt tctgcttcca tgga
```

Figure 12

- *tg1 997-1025*
- 5'- CXGGX AGGGG AGGGX GGAGG GAGGA CXGT -3' (SEQ ID NO:132)
- *tg2 951-978*
- 5'- TXGCC CXGCA GXGCT GCCXG CXGGG XGG -3' (SEQ ID NO:133)
- *tg3 805-830*
- 5'- AGGGG XGGGG AXGCT GAGXG CACXG A -3' (SEQ ID NO:134)
- *tg4 777-802*
- 5'- AGGGX GXGGG CTGCT GGGXG GGXGA -3' (SEQ ID NO:135)
- *tg5 728-762*
- 5'- GCCTG GXGGX GXGAG CXGGG CACCX GGGCX GAXGA -3' (SEQ ID NO:136)
- *tg6 641-661*
- 5'- AGXGT GXGGG GTXGG XGCXG GCXGX GTA-3' (SEQ ID NO:137)
- *tg7 563-591*
- 5'- GXGGX GGAXG GAGCX GCCXG GGCAC CXGT -3' (SEQ ID NO:138)
- *tg8** 754-787*
- 5'- GGGXG GGGXG ACCTG GGATC CCAGG CCTGG XGG -3' (SEQ ID NO:139)
- *tg9 521-546*
- 5'- CXGCT CCTGG GGCAT CTCTG GGGXG G -3' (SEQ ID NO:140)

Figure 12 (cont.)

- *tg10** 1111-1137*
5'- AXGGG XGGGX GGGCA GCAGG CTCTC CA -3' (SEQ ID NO:141)

- *tg11** 328-357*
5'- CXGCC TTACC TCCCA GGCAG GCCAC ATXGT -3' (SEQ ID NO:142)

- *tg12** 185-209*
5'- CXGAA AGAGG GGTGT GTGGG CCXGA -3' (SEQ ID NO:143)

- *tg13** 1064-1094*
5'- GXGGT GCCXG AGTGG XGGAG XGGXG CXGXG G -3' (SEQ ID NO:144)

Figure 12 (cont.)

- *Ntg1 1-25*

5'-CATGT TCTCCAGGTA CCCGGAGCTC -3' (SEQ ID NO:145)

- *Ntg2 31-60*

5'-C GGTGACCCTC ATGGGGACAG TACACCCGGG -3' (SEQ ID NO:146)

- *Ntg3 81-110*

5'-GATAGAGGGA AGACATTCTG GGCGAAGAGT -3' (SEQ ID NO:147)

- *Ntg4 453-480*

5'-GTGAGTTTCG CCGGCCGCTT GCCAAGAC -3' (SEQ ID NO:148)

- *Ntg5 614-640*

5'- CCGCGTAGCC GGATTGTCCT GGGCCGC -3' (SEQ ID NO:149)

- *Ntg6 662-682*

5'- CG CCGTGCGGGCA GCGGACTCC -3' (SEQ ID NO:150)

- *Ntg7 691-716*

5'- GCGCCT GACTTCAGAC ACCACCCCCG -3' (SEQ ID NO:151)

- *Ntg8 876-912*

5'- GC GACCGGGGCA CAGCTGACCC CCCCCTCCCG CCCCG -3' (SEQ ID NO:152)

- *Ntg9 913-940*

5'- GCGGCTACCG TCACCTCCTC GCCACTCG -3'(SEQ ID NO:153)

Figure 12 (cont.)

- *Ntg10 1151-1175*
- 5'- GCGAA CAGGGGCGAGC TGTCCAGCCG -3' (SEQ ID NO:154)

- *Ntg11 1226-1250*
- 5'- GCCACGGGGCG GGTCTGCACT CAGCG -3' (SEQ ID NO:155)

- *Ntg12 257-284*
- 5'-GGGT CTCTGTGACG AATCTGGTGT GTGG -3' (SEQ ID NO:156)

- *Ntg13 361-384*
- 5'-CAGT TCCCATCAAT TCTGCAACGC -3' (SEQ ID NO:157)

- *Ntg14 1038-1062*
- 5'-GC GGGGGAAAAA GACGCAGACT AGG -3' (SEQ ID NO:158)

- *Ntg15 1193-1223*
- 5'-GAC GTGCTGTTCT CCAAGGCCTG GCACGCAG -3' (SEQ ID NO:159)

Figure 13

BxPC3

| Lead | Concentration | average % Inhib | 1 st dev |
|---|---|---|---|
| kr1 | 5 uM | 93% | 1.6% |
| kr1 | 15 uM | 99% | 0.4% |
| kr1 | 30 uM | 99% | 0.1% |
| kr2 | 5 uM | 12% | 5.9% |
| Kr2 | 10 uM | 14% | 10.2% |
| Kr2 | 10 uM | 20% | 6.9% |
| kr2 | 15 uM | 87% | 6.0% |
| Kr2 | 20 uM | 87% | 1.7% |
| Kr2 | 20 uM | 91% | 1.7% |
| kr2 | 30 uM | 99% | 0.1% |
| Kr3 | 10 uM | 14% | 5.0% |
| Kr3 | 20 uM | 49% | 14.3% |
| kr3 | 50 uM | 99% | 0.1% |
| kr4 | 5 uM | 53% | 2.6% |
| Kr4 | 10 uM | 18% | 4.5% |
| kr4 | 15 uM | 99% | 0.1% |
| Kr4 | 20 uM | 93% | 1.4% |
| kr4 | 30 uM | 99% | 0.1% |
| Kr5 | 10 uM | 16% | 4.5% |
| Kr5 | 20 uM | 17% | 3.9% |
| kr5 | 50 uM | 99% | 0.4% |
| Kr6 | 10 uM | 15% | 3.9% |
| Kr6 | 10 uM | 16% | 6.5% |
| Kr6 | 20 uM | 25% | 6.9% |
| Kr6 | 20 uM | 18% | 6.8% |
| kr6 | 50 uM | 68% | 3.9% |

Myc-MT-1

| Lead | Concentration | average % Inhib | 1 st dev |
|---|---|---|---|
| kr1 | 10 uM | 77% | 2.5% |

Figure 14

| Lead | Concentration | average % Inhib | repeats | 1 st dev |
|---|---|---|---|---|
| BL1 | 10 uM | 12% | 8 | 6% |
| BL2 | 10 uM | 76% | 8 | 3% |
| BL2 | 20 uM | 94% | 4 | 3% |
| BL3 | 10 uM | 20% | 8 | 4% |
| BL4 | 10 uM | 9% | 8 | 7% |
| BL5 | 10 uM | 26% | 8 | 5% |
| BL6 | 10 uM | 47% | 8 | 2% |
| BL7 | 10 uM | 15% | 8 | 8% |
| BL8 | 20 uM | 81% | 4 | 4% |

M14

| Lead | Concentration | average % Inhib | repeats | 1 st dev |
|---|---|---|---|---|
| BL1 | 10 uM | 27% | 4 | 2% |
| BL2 | 10 uM | 65% | 4 | 3% |
| BL2 | 10 uM | 35% | 4 | 6% |
| BL2 | 20 uM | 98% | 4 | 2% |
| BL3 | 10 uM | 20% | 4 | 10% |
| BL4 | 10 uM | 21% | 4 | 11% |
| BL5 | 10 uM | 18% | 4 | 5% |
| BL6 | 10 uM | 60% | 4 | 1% |
| BL7 | 10 uM | 97% | 4 | 1% |
| BL7 | 10 uM | 98% | 4 | 0% |
| BL7 | 20 uM | 98% | 4 | 0% |

BT474

| Lead | Concentration | average % Inhib | repeats | 1 st dev |
|---|---|---|---|---|
| BL1 | 10 uM | 45% | 4 | 5% |
| BL2 | 10 uM | 67% | 4 | 8% |
| BL3 | 10 uM | 85% | 4 | 6% |
| BL4 | 10 uM | 45% | 4 | 14% |
| BL5 | 10 uM | 84% | 4 | 6% |
| BL6 | 10 uM | 71% | 4 | 5% |
| BL7 |  | 76% | 4 | 2% |

T47D

| Lead | Concentration | average % Inhib | repeats | 1 st dev |
|---|---|---|---|---|
| BL2 | 10 uM | 42% | 4 | 10% |
| BL2 | 20 uM | 88% | 4 | 3% |
| BL7 | 10 uM | 95% | 4 | 1% |
| BL7 | 20 uM | 96% | 4 | 1% |
| BL8 | 2 uM | 25% | 4 | 12% |
| BL8 | 6 uM | 33% | 4 | 7% |
| BL8 | 20 uM | 59% | 4 | 24% |

FSCCL

| Lead | Concentration | average % Inhib | repeats | 1 st dev |
|---|---|---|---|---|
| BL2 | 10 uM post 8 hrs | 60% | 4 | 7% |

Figure 14 (cont.)

| | | | | |
|---|---|---|---|---|
| BL2 | 10 uM post 16 hrs | 86.50% | 4 | 6% |
| BL2 | 10 uM post 24 hrs | 95% | 4 | 4% |
| BL2 | 10 uM post 32 hrs | 98.90% | 4 | 2% |
| BL2 | 10 uM post 40 hrs | 100% | 4 | 0% |
| BL2 | 10 uM post 48 hrs | 100% | 4 | 0% |
| BL6 | 10 uM | 40% | 4 | 13% |
| BL6 | 10 uM | 71.60% | 4 | 8% |
| BL6 | 10 uM | 96.30% | 4 | 5% |
| BL6 | 10 uM | 100% | 4 | 0% |
| BL6 | 10 uM | 100% | 4 | 0% |
| BL6 | 10 uM | 100% | 4 | 0% |
| BL7 | 1 uM post 8 hrs | -14% | 4 | 9% |
| BL7 | 3 uM post 8 hrs | 14% | 4 | 16% |
| BL7 | 10 uM post 8 hrs | 5% | 4 | 26% |
| BL7 | 1 uM post 16 hrs | 6% | 4 | 11% |
| BL7 | 3 uM post 16 hrs | 54% | 4 | 7% |
| BL7 | 10 uM post 16 hrs | 86% | 4 | 6% |
| BL7 | 1 uM post 24 hrs | 28% | 4 | 21% |
| BL7 | 3 uM post 24 hrs | 76% | 4 | 5% |
| BL7 | 10 uM post 24 hrs | 100% | 4 | 0% |
| BL7 | 1 uM post 32 hrs | 37% | 4 | 12% |
| BL7 | 3 uM post 32 hrs | 93% | 4 | 4% |
| BL7 | 10 uM post 32 hrs | 100% | 4 | 0% |
| BL7 | 1 uM post 48 hrs | 40% | 4 | 16% |
| BL7 | 3 uM post 48 hrs | 100% | 4 | 0% |
| BL7 | 10 uM post 48 hrs | 100% | 4 | 0% |
| BL8 | 1 uM post 8 hrs | 3.80% | 4 | 10% |
| BL8 | 3 uM post 8 hrs | 19% | 4 | 16% |
| BL8 | 10 uM post 8 hrs | 38% | 4 | 14% |
| BL8 | 1 uM post 16 hrs | 13.40% | 4 | 10% |
| BL8 | 3 uM post 16 hrs | 18% | 4 | 3% |
| BL8 | 10 uM post 16 hrs | 57% | 4 | 6% |
| BL8 | 1 uM post 24 hrs | 31.30% | 4 | 8% |
| BL8 | 3 uM post 24 hrs | 42% | 4 | 7% |
| BL8 | 10 uM post 24 hrs | 82% | 4 | 7% |
| BL8 | 1 uM post 32 hrs | 33% | 4 | 9% |
| BL8 | 3 uM post 32 hrs | 42.50% | 4 | 4% |
| BL8 | 10 uM post 32 hrs | 95.70% | 4 | 3% |
| BL8 | 1 uM post 40 hrs | 36% | 4 | 3% |
| BL8 | 3 uM post 40 hrs | 45.40% | 4 | 8% |
| BL8 | 10 uM post 40 hrs | 100% | 4 | 0% |
| BL8 | 1 uM post 48 hrs | 35% | 4 | 3% |
| BL8 | 3 uM post 48 hrs | 49% | 4 | 9% |
| BL8 | 10 uM post 48 hrs | 100% | 4 | 0% |

NMuMG

| | | | | |
|---|---|---|---|---|
| BL2 | 10 uM | 4% | 4 | 6% |
| BL2 | 20 uM | 5.50% | 4 | 6% |
| BL7 | No concentration | 52% | 8 | 14% |
| BL8 | 20 uM | 27% | 4 | 6% |

Figure 14 (cont.)

MCF7

| BL8 | 5 uM  | 41% | 4 | 4% |
|-----|-------|-----|---|----|
| BL8 | 10 uM | 61% | 4 | 1% |
| BL8 | 20 uM | 83% | 4 | 5% |

Myc-MT-1

| BL2 | 1 uM  | 4%  | 4 | 8% |
|-----|-------|-----|---|----|
| BL2 | 3 uM  | 6%  | 4 | 2% |
| BL2 | 10 uM | 37% | 4 | 8% |

Figure 15

MCF10a

| Lead | Concentration | average % Inhib | 1 st dev | repeats |
|---|---|---|---|---|
| HR3 | 10 uM | 12% | 8% | 8 |
| HR4 | 10 uM | -5% | 8% | 8 |

MDA-MB-231

| Lead | Concentration | average % Inhib | 1 st dev | repeats |
|---|---|---|---|---|
| HR23 | 1 uM | 18% | 4% | 4 |
| HR23 | 2.5 uM | 19% | 4% | 4 |
| HR23 | 5 uM | 32% | 2% | 4 |
| HR23 | 10 uM | 98% | 1% | 4 |
| HR23 | 10 uM | 74% | 4% | 4 |
| HR23 | 20 uM | 78% | 1% | 4 |

T47D

| Lead | Concentration | average % Inhib | 1 st dev | repeats |
|---|---|---|---|---|
| HR2 | 10 uM | 92% | 1% | 5 |
| HR2 | 10 uM | 86% | 3% | 4 |
| HR2 | 10 uM | 58% | 2% | 4 |
| HR2 | 20 uM | 88% | 4% | 4 |
| HR3 | 10 uM | 89% | 5% | 4 |
| HR3 | 10 uM | 45% | 5% | 4 |
| HR3 | 20 uM | 97% | 2% | 4 |
| HR5 | 10 uM | -15% | 18% | 5 |
| HR6 | 10 uM | 66% | 28% | 5 |
| HR11 | 10 uM | 46% | 7% | 5 |
| HR23 | 1 uM | 0% | 3% | 4 |
| HR23 | 1 uM | 26% | 15% | 4 |
| HR23 | 2.5 uM | 37% | 6% | 4 |
| HR23 | 3 uM | 22% | 9% | 4 |
| HR23 | 5 uM | 75% | 2% | 4 |
| HR23 | 10 uM | 96% | 2% | 2 |
| HR23 | 10 uM | 92% | 1% | 4 |
| HR23 | 10 uM | 99% | 1% | 4 |
| HR23 | 10 uM | 68% | 2% | 4 |
| HR23 | 20 uM | 94% | 3% | 4 |
| HR23 | 20 uM | 69% | 2% | 4 |
| HR23* | 10 uM | 89% | 1% | 4 |
| HR23* | 20 uM | 91% | 0% | 4 |

BT-474

| Lead | Concentration | average % Inhib | 1 st dev | repeats |
|---|---|---|---|---|
| HR2 | 10 uM | 84% | 2% | 5 |
| HR5 | 10 uM | 37% | 13% | 5 |

Figure 15 (cont.)

| Lead | Concentration | average % Inhib | 1 st dev | repeats |
|---|---|---|---|---|
| HR6 | 10 uM | 71% | 1% | 4 |
| HR11 | 10 uM | 75% | 7% | 4 |
| HR23 | 10 uM | 98% | 1% | 4 |

MCF7

| Lead | Concentration | average % Inhib | 1 st dev | repeats |
|---|---|---|---|---|
| HR6 | no concentration | 94% | 2% | 4 |
| HR11 | no concentration | 96% | 2% | 4 |

NMuMG

| Lead | Concentration | average % Inhib | 1 st dev | repeats |
|---|---|---|---|---|
| HR2 | 10 uM | 19% | 10% | 4 |
| HR2 | 20 uM | 35% | 12% | 4 |
| HR23 | no concentration | 75% | 4% | 8 |

Figure 16

| Lead | Concentration | average % Inhib | 1 st dev | repeats |
|---|---|---|---|---|
| RZ1X | 5 uM:2159-5 | 80% | 4% | 4 |
| RZ1X | 5 uM:2159-6 | 76% | 4% | 4 |
| RZ1X | 5 uM:2159-5 | 49% | 7% | 4 |
| RZ1X | 5 uM:2159-6 | 61% | 11% | 4 |
| RZ1X | 10 uM | 96% | 2% | 7 |
| RZ1X | 10 uM:2159-1 | 97% | 1% | 4 |
| RZ1X | 10 uM:2159-1 | 86% | 2% | 4 |
| RZ1X | 20 uM | 88% | N/A | |
| RZ1X | 20 uM:2159-5 | 97% | 3% | 4 |
| RZ1X | 20 uM:2159-6 | 98% | 1% | 4 |
| RZ1X | 20 uM:2159-5 | 95% | 1% | 4 |
| RZ1X | 20 uM:2159-6 | 97% | 1% | 4 |
| rz1 | 20 uM | 67% | N/A | |
| rz4x | 20 uM | -3% | N/A | |
| rh1x | 20 uM | 0% | N/A | |
| rzmx / rmx | 20 uM | -2% | N/A | |
| rz6x | 10 uM | 91% | 2% | 4 |
| RZ9X | 10 uM | 88% | 4% | 4 |
| RZ10X | 10 uM | 58% | 3% | 4 |
| RZ1**X | 10 uM | 20% | 6% | 4 |

| Lead | Concentration | average % Inhib | 1 st dev | repeats |
|---|---|---|---|---|
| RZ1X | 10 uM | 78% | 1% | 8 |
| RZ1X | 10 uM:1979-1 | 91% | 5% | 4 |
| RZ1X | 10 uM:1979-1 | 97% | 2% | 3 |
| RZ1X | 10 uM:2159-6 | 92% | 3% | 4 |
| RZ1X | 20 uM:2159-1 | 82% | 5% | 4 |
| RZ1X | 20 uM:2159-6 | 93% | 1% | 4 |
| RZ1X | 20 uM:2159-1 | 99% | 0% | 4 |
| RZ1X | 20 uM:2159-6 | 99% | 0% | 4 |
| rz6x | 10 uM | 60% | 3% | 4 |
| rz6x | 20 uM | 72% | 22% | 4 |
| RZ9X | 10 uM | 86% | 1% | 4 |
| RZ9X | 10 uM | 98% | 1% | 4 |
| RZ9X | 20 uM | 93% | 2% | 4 |
| RZ10X | 10 uM | 44% | 32% | 4 |
| RZ10X | 20 uM | 83% | 2% | 4 |
| RZ1**X | 10 uM | 23% | 14% | 4 |
| RZ1**X | 20 uM | 60% | 11% | 4 |

| Lead | Concentration | average % Inhib | 1 st dev | repeats |
|---|---|---|---|---|
| RZ1X | 10 uM | -1% | 9% | 8 |

Figure 16 (cont.)

| Lead | Concentration | average % Inhib | 1 st dev | repeats |
|---|---|---|---|---|
| RZ1X | 10 uM | 12% | 6% | 8 |
| | | | | |
| Lead | Concentration | average % Inhib | 1 st dev | repeats |
| RZ1X | 1 uM | 0.40% | 2% | 4 |
| RZ1X | 3 uM | 2.70% | 2% | 4 |
| RZ1X | 10 uM | 95% | 3% | 8 |
| RZ1X | 10 uM:1979-1 | 97% | 1% | 3 |
| RZ1X | 10 uM:1979-1 | 90% | 3% | 4 |
| RZ1X | 10 uM:1979-1 | 65% | 3% | 4 |
| RZ1X | 10 uM:2159-6 | 99% | 0% | 4 |
| RZ1X | 20 uM:1979-1 | 90% | 7% | 3 |
| RZ1X | 20 uM:1979-1 | 97% | 1% | 4 |
| RZ1X | 20 uM:2159-6 | 99% | 0% | 4 |
| ARZ1X | 10 uM | 9% | 4% | 4 |
| G5RZ1X | 10 uM | 52% | 6% | 4 |
| G21RZ1X | 10 uM | 14% | 5% | 4 |
| RZ1*X | 10 uM | 1% | 1.2% | 4 |
| RZ1*X | 20 uM | 4% | 2.9% | 4 |
| RZ1**X | 10 uM | 35% | 10% | 4 |
| RZ1**X | 10 uM | 65% | 33% | 3 |
| RZ1**X | 20 uM | 89% | 5% | 3 |
| RZ1-X | 10 uM | 70% | 6.2% | 4 |
| RZ1-X | 20 uM | 99% | 0.2% | 4 |
| RZ1uX | 10 uM | 1% | 6.8% | 4 |
| RZ1uX | 20 uM | -1% | 3.4% | 4 |
| rzx | 10 uM | 77% | 2% | 8 |
| rzmx / rmx | 10 uM | 29% | 9% | 8 |
| erz1x | 10 uM | 87% | 1% | 8 |
| srz1x | 10 uM | 65% | 5% | 8 |
| drz1x | 10 uM | -5% | 12% | 8 |
| rz2x | 10 uM | 77% | 2% | 8 |
| rz2x | 10 uM | 79% | 1% | 8 |
| rz3x | 10 uM | 3% | 6% | 8 |
| rz3x | 10 uM | 11% | 6% | 8 |
| rz4x | 10 uM | 43% | 4% | 4 |
| rz4x | 10 uM | 21% | 8.6% | 4 |
| rz4x | 20 uM | 99% | 0.1% | 4 |
| rz5x | 10 uM | 55% | 4% | 8 |
| rz5x | 10 uM | 32% | 3% | 8 |
| rz5x | 10 uM | 65% | 8% | 4 |
| rz5x | 20 uM | 47% | 25% | 8 |
| rz6x | 1 uM | 2% | 11% | 8 |
| rz6x | 2.5 uM | 12% | 11% | 8 |
| rz6x | 5 uM | 35% | 10% | 8 |
| rz6x | 5 uM | 42% | 11% | 8 |
| rz6x | 10 uM | 81% | 3% | 8 |

Figure 16 (cont.)

| | | | | |
|---|---|---|---|---|
| *rz6x* | 10 uM | 97% | 2% | 3 |
| *rz6x* | 10 uM | 94% | 4% | 4 |
| *rz6x* | 20 uM | 97% | 3% | 3 |
| *rz6x* | 36 uM | 114% | 8% | 8 |
| RZ6RX | 10 uM | 2% | 3.3% | 4 |
| RZ6RX | 20 uM | 82% | 1.6% | 4 |
| RZ6LX | 10 uM | -5% | 4.4% | 4 |
| RZ6LX | 20 uM | 99% | 0.1% | 4 |
| RZ6UX | 10 uM | -1% | 5.9% | 4 |
| RZ6UX | 20 uM | 99% | 0.2% | 4 |
| rz7x | 10 uM | 16% | 23% | 8 |
| rz7x | 10 uM | 22% | 2% | 4 |
| rz7x | 10 uM | 0% | 5.2% | 4 |
| rz7x | 20 uM | 31% | 1.5% | 4 |
| rz7x | 20 uM | 51% | 12.7% | 4 |
| rz7x | 40 uM | 99% | 0.1% | 4 |
| rz8x | 10 uM | 5% | 8% | 8 |
| rz8x | 10 uM | -3% | 6.8% | 4 |
| rz8x | 10 uM | 15% | 7.2% | 4 |
| rz8x | 20 uM | 98% | 0.5% | 4 |
| rz8x | 20 uM | 97% | 0.6% | 4 |
| RZ9X | 10 uM | 98% | 0% | 8 |
| RZ9X | 10 uM | 99% | 0% | 4 |
| RZ9X | 10 uM | 95% | 0% | 3 |
| RZ9X | 20 uM | 93% | 0% | 3 |
| RZ10X | 10 uM | 86% | 14% | 8 |
| RZ10X | 10 uM | 96% | 1% | 3 |
| RZ10X | 10 uM | 80% | 7% | 4 |
| RZ10X | 20 uM | 94% | 3% | 3 |
| RZ11X | 10 uM | 5% | 5.0% | 4 |
| RZ11X | 20 uM | 99% | 0.3% | 4 |

| Lead | Concentration | average % Inhib | 1 st dev | repeats |
|---|---|---|---|---|
| RZ1X | 10 uM | 22% | 11% | 8 |

| Lead | Concentration | average % Inhib | 1 st dev | repeats |
|---|---|---|---|---|
| RZ1X | 1 uM post 8 hrs | 3.28% | 16% | 4 |
| RZ1X | 1 uM post 16 hrs | 1.96% | 5% | 4 |
| RZ1X | 1 uM post 24 hrs | -0.81% | 14% | 4 |
| RZ1X | 1 uM post 32 hrs | 5.20% | 6% | 4 |
| RZ1X | 1 uM post 40 hrs | 5.51% | 6% | 4 |
| RZ1X | 1 uM post 48 hrs | 6.49% | 6% | 4 |
| RZ1X | 3 uM post 8 hrs | 9.84% | 16% | 4 |
| RZ1X | 3 uM post 16 hrs | 6.86% | 12% | 4 |
| RZ1X | 3 uM post 24 hrs | 5.65% | 14% | 4 |
| RZ1X | 3 uM post 32 hrs | 5.20% | 7% | 4 |
| RZ1X | 3 uM post 40 hrs | 6.99% | 9% | 4 |

Figure 16 (cont.)

| Lead | Concentration | average % Inhib | 1 st dev | repeats |
|---|---|---|---|---|
| RZ1X | 3 uM post 48 hrs | 11.36% | 3% | 4 |
| RZ1X | 5 uM day 1 | 53% | N/A | 1 |
| RZ1X | 10 uM post 8 hrs | 29.51% | 3% | 4 |
| RZ1X | 10 uM post 16 hr | 35.29% | 10% | 4 |
| RZ1X | 10 uM post 24 hr | 28.23% | 14% | 4 |
| RZ1X | 10 uM post 32 hr | 38.15% | 6% | 4 |
| RZ1X | 10 uM post 40 hr | 56.99% | 5% | 4 |
| RZ1X | 10 uM post 48 hr | 62.01% | 4% | 4 |
| RZ1**X | 10 uM | -8% | N/A | |
| rz6x | 10 uM | 79% | N/A | |
| RZ9X | 10 uM | 90% | N/A | |

| Lead | Concentration | average % Inhib | 1 st dev | repeats |
|---|---|---|---|---|
| erz1x | 10 uM | 83% | 1% | 8 |

| Lead | Concentration | average % Inhib | 1 st dev | repeats |
|---|---|---|---|---|
| RZ1X | 10 uM: 1979-1 | 95% | 4% | 4 |
| RZ1X | 20 uM: 1979-1 | 98% | 1% | 4 |
| RZ1**X | 10 uM | 15% | 13% | 4 |
| RZ1**X | 20 uM | 37% | 5% | 4 |
| RZ9X | 10 uM | 97% | 1% | 4 |
| RZ9X | 20 uM | 98% | 1% | 4 |

| Lead | Concentration | average % Inhib | 1 st dev | repeats |
|---|---|---|---|---|
| RZ1X | 10 uM:1979-1 | 77% | 4% | 4 |
| RZ1**X | 10 uM | 2% | 2% | 4 |
| rz6x | 10 uM | 56% | 4% | 4 |
| rz6x | 10 uM | 91% | 1% | 4 |
| RZ9X | 10 uM | 62% | 4% | 4 |
| RZ10X | 10 uM | 21% | 2% | 4 |

| Lead | Concentration | average % Inhib | 1 st dev | repeats |
|---|---|---|---|---|

| Lead | Concentration | average % Inhib | 1 st dev | repeats |
|---|---|---|---|---|
| RZ1X at 10 uM | 10 uM | 3.70% | 7% | 8 |
| RZ1X | 10 uM:2159-5 | 14% | 7% | 4 |
| RZ1X | 20 uM:2159-5 | 36% | 24% | 4 |
| RZ1X | 10 uM:2159-5, 2< | 13.00% | 47% | 4 |
| RZ1X | 10 uM:2159-5, 9( | 36.00% | 24% | 4 |

Figure 16 (cont.)

| Lead | Concentration | average % Inhib | 1 st dev | repeats |
|---|---|---|---|---|
| RZ1X | 1 uM | 7% | 2% | 4 |
| RZ1X | 3 uM | 23% | 4% | 4 |
| RZ1X | 10 uM | 66% | 4% | 4 |

Figure 17

MCF7

| Lead | Concentration | average % Inhib | 1 st dev | repeats |
|---|---|---|---|---|
| cm1 | 10 uM | 21% | 15% | 7 |
| cm1 | 10 uM | 38% | 12% | 8 |
| cm2 | 10 uM | 75% | 17% | 7 |
| cm2 | 10 uM | 54% | 4% | 8 |
| cm3 | 10 uM | 86% | 3% | 7 |
| cm3 | 10 uM | 71% | 2% | 8 |
| cm3 | 10 uM | 70% | 2% | 4 |
| cm4 | 1 uM | 6% | 5% | 4 |
| cm4 | 3 uM | -9% | 4% | 4 |
| cm4 | 6 uM | 7% | 17% | 4 |
| cm4 | 10 uM | 87% | 6% | 7 |
| cm4 | 10 uM | 71% | 2% | 8 |
| cm4 | 10 uM | 84% | 2% | 4 |
| cm4 | 10 uM | 24% | 9% | 4 |
| cm4 | 20 uM | 45% | 5% | 4 |
| cm5 | 10 uM | 27% | 9% | 4 |
| cm5 | 20 uM | 57% | 6% | 4 |
| cm6 | 10 uM | 88% | 2% | 4 |
| cm6 | 20 uM | 93% | 1% | 4 |
| cm7 | 10 uM | 88% | 4% | 4 |
| cm7 | 20 uM | 93% | 0% | 4 |

MCF10a

| Lead | Concentration | average % Inhib | 1 st dev | repeats |
|---|---|---|---|---|
| cm1 | 10 uM | 13% | 16% | 8 |
| cm2 | 10 uM | 69% | 2% | 8 |
| cm3 | 10 uM | 58% | 5% | 8 |
| cm3 | 10 uM | 73% | 1% | 8 |
| cm4 | 10 uM | 56% | 4% | 8 |
| cm4 | 10 uM | 74% | 1% | 8 |

MCF10ca1a

| Lead | Concentration | average % Inhib | 1 st dev | repeats |
|---|---|---|---|---|
| cm3 | 10 uM | 55% | 6% | 4 |
| cm3 | 20 uM | 75% | 9% | 4 |
| cm4 | 10 uM | 83% | 4% | 4 |
| cm4 | 10 uM | 93% | 4% | 4 |
| cm4 | 20 uM | 89% | 3% | 4 |

MDA-MB-231

| Lead | Concentration | average % Inhib | 1 st dev | repeats |
|---|---|---|---|---|
| cm1 | 10 uM | -8% | 10% | 8 |
| cm3 | 10 uM | 17% | 7% | 4 |
| cm3 | 20 uM | 95% | 1% | 4 |

Figure 17(cont.)

| Lead | Concentration | average % Inhib | 1 st dev | repeats |
|---|---|---|---|---|
| mac3G | 5 uM | 5% | 4.9% | 4 |
| mac3G | 10 uM | 26% | 4.5% | 4 |
| mac3G | 20 uM | 99% | 0.1% | 4 |
| cm4 | 1 uM#3 | 6% | 2% | 4 |
| cm4 | 3 uM#3 | 9% | 4% | 4 |
| cm4 | 10 uM | 33% | 6% | 4 |
| cm4 | 10 uM#3 | 62% | 6% | 4 |
| cm4 | 10 uM | 12% | 6.2% | 4 |
| cm4 | 20 uM#3 | 78% | 3% | 4 |
| cm4 | 20 uM | 64% | 3.9% | 4 |
| cm5 | 10 uM | 9% | 9.0% | 4 |
| cm5 | 20 uM | 80% | 2.3% | 4 |
| cm6 | 10 uM | 19% | 2.6% | 4 |
| cm6 | 20 uM | 100% | 0.0% | 4 |
| cm7 | 10 uM | 84% | 9.2% | 4 |
| cm7 | 20 uM | 100% | 0.1% | 4 |

MDA-MB 435 erb

| Lead | Concentration | average % Inhib | 1 st dev | repeats |
|---|---|---|---|---|
| cm3 | 10 uM | 11% | 4% | 8 |

FSCCL

| Lead | Concentration | average % Inhib | 1 st dev | repeats |
|---|---|---|---|---|
| cm3 | no concentration | 66% | N/A | 1 |
| cm4 | no concentration | 71% | N/A | 1 |
| MAC-M4 | 1 uM post 8 hrs | -8% | 10% | 4 |
| MAC-M4 | 1 uM post 16 hrs | 22% | 16% | 4 |
| MAC-M4 | 1 uM post 24 hrs | 17% | 16% | 4 |
| MAC-M4 | 1 uM post 32 hrs | 19% | 9% | 4 |
| MAC-M4 | 1 uM post 48 hrs | 24% | 13% | 4 |
| MAC-M4 | 3 uM post 8 hrs | -15% | 15% | 4 |
| MAC-M4 | 3 uM post 16 hrs | 29% | 8% | 4 |
| MAC-M4 | 3 uM post 24 hrs | 50% | 8% | 4 |
| MAC-M4 | 3 uM post 32 hrs | 49% | 2% | 4 |
| MAC-M4 | 3 uM post 48 hrs | 51% | 8% | 4 |
| MAC-M4 | 10 uM post 8 hrs | 8% | 32% | 4 |
| MAC-M4 | 10 uM post 16 hr | 94% | 5% | 4 |
| MAC-M4 | 10 uM post 24 hr | 100% | 0% | 4 |
| MAC-M4 | 10 uM post 32 hr | 100% | 0% | 4 |
| MAC-M4 | 10 uM post 48 hr | 100% | 0% | 4 |

T47D

| Lead | Concentration | average % Inhib | 1 st dev | repeats |
|---|---|---|---|---|
| cm3 | no concentration | 42% | 5% | 4 |
| cm4 | no concentration | 61% | 5% | 4 |

Myc-mt-1

| Lead | Concentration | average % Inhib | 1 st dev | repeats |
|---|---|---|---|---|

Figure 17(cont.)

| | | | |
|---|---|---|---|
| mac3G | 5 uM | 18% | 7.6% |
| mac3G | 10 uM | 42% | 15.6% |
| mac3G | 20 uM | 80% | 1.2% |
| cm4 | 1 uM#3 | 14.7% | 6% |
| cm4 | 3 uM#3 | 22.3% | 5% |
| cm4 | 10 uM#3 | 54.6% | 2% |
| cm4 | 20 uM#3 | 88.4% | 1% |
| cm7 | 20 uM | 86% | 1.2% |

Figure 18

| Lead | Concentration | average % Inhib | 1 st dev | repeats |
|---|---|---|---|---|
| tga1 | 10 uM | -3% | 5% | 8 |
| tga2 | 10 uM | 1% | 2% | 8 |
| tga3 | 10 uM | 63% | 8% | 8 |
| tga3 | 10 uM | 94% | 1% | 2 |
| tga4 | 10 uM | -9% | 9% | 8 |
| tga4 | 10 uM | -3% | 1% | 4 |
| tga5 | 10 uM | -2% | 3% | 8 |
| tga5 | 10 uM | 69% | 8.7% | 4 |
| tga5 | 20 uM | 100% | 0.1% | 4 |
| tga6 | 10 uM | -5% | 2% | 8 |
| tga7 | 10 uM | 7% | 2% | 8 |
| tga8 | 1 uM | -7% | 17% | 8 |
| tga8 | 1 uM | 13% | 10% | 8 |
| tga8 | 2.5 uM | 0% | 14% | 8 |
| tga8 | 5 uM | 12% | 10% | 8 |
| tga8 | 5 uM | 79% | 14% | 8 |
| tga8 | 10 uM | 89% | 5% | 8 |
| tga8 | 10 uM | 88% | 1% | 3 |
| tga8 | 10 uM | 78% | 6.1% | 4 |
| tga8 | 20 uM | 94% | 3% | 3 |
| tga8 | 20 uM | 100% | 0.1% | 4 |
| tga9 | 10 uM | 67% | 3% | 8 |
| tga10 | 1 uM | 20% | 3% | 4 |
| tga10 | 2.5 uM | 27% | 3% | 4 |
| tga10 | 5 uM | 36% | 2% | 4 |
| tga10 | 10 uM | 84% | 2% | 8 |
| tga10 | 10 uM | 95% | 2% | 3 |
| tga10 | 10 uM | 61% | 2% | 4 |
| tga10 | 20 uM | 96% | 2% | 3 |
| tga10 | 20 uM | 79% | 2% | 4 |
| tga11 | 1 uM | -1% | 10% | 8 |
| tga11 | 1 uM | -3% | 17% | 8 |
| tga11 | 1 uM | -19% | 7% | 8 |
| tga11 | 2 uM | -12% | 13% | 8 |
| tga11 | 2.5 uM | -3% | 15% | 8 |
| tga11 | 5 uM | -4% | 10% | 8 |
| tga11 | 5 uM | 50% | 23% | 8 |
| tga11 | 5 uM | -29% | 20% | 8 |
| tga11 | 10 uM | 86% | 3% | 8 |
| tga11 | 10 uM | 93% | 6% | 3 |
| tga11 | 10 uM | 98% | 1% | 4 |
| tga11 | 20 uM | 97% | 2% | 3 |
| tga11 | 20 uM | 99% | 0.4% | 4 |
| tga12 | 10 uM | 59% | 2% | 8 |
| tga12 | 10 uM | 99% | 1% | 2 |
| tga13 | 10 uM | 71% | 17% | 8 |
| tga13 | 10 uM | 99% | 1% | 3 |

Figure 18(cont.)

| Lead | Concentration | average % Inhib | 1 st dev | repeats |
|---|---|---|---|---|
| tga5 | 20 uM | 92% | 1% | 4 |
| tga5 | 40 uM | 99% | 0% | 4 |
| tga8 | 10 uM | 17% | 2% | 4 |
| tga8 | 20 uM | 93% | 1% | 4 |
| tga8 | 40 uM | 99% | 0% | 4 |
| tga10 | 1 uM | 6% | 9% | 4 |
| tga10 | 2.5 uM | 16% | 6% | 4 |
| tga10 | 5 uM | 53% | 2% | 4 |
| tga10 | 10 uM | 95% | 2% | 4 |
| tga10 | 10 uM | 76% | 2% | 4 |
| tga10 | 20 uM | 76% | 2% | 4 |
| tga10 | 40 uM | 84% | 1% | 4 |
| tga11 | 2 uM | 26% | 7% | 4 |
| tga11 | 6 uM | 24% | 1% | 4 |
| tga11 | 10 uM | 79% | 5% | 4 |
| tga11 | 20 uM | 61% | 16% | 4 |
| tga11 | 20 uM | 53% | 7% | 4 |
| tga11 | 40 uM | 93% | 1% | 4 |

| Lead | Concentration | average % Inhib | 1 st dev | repeats |
|---|---|---|---|---|
| tga10 | 10 uM | 73% | 11% | 8 |

Figure 20
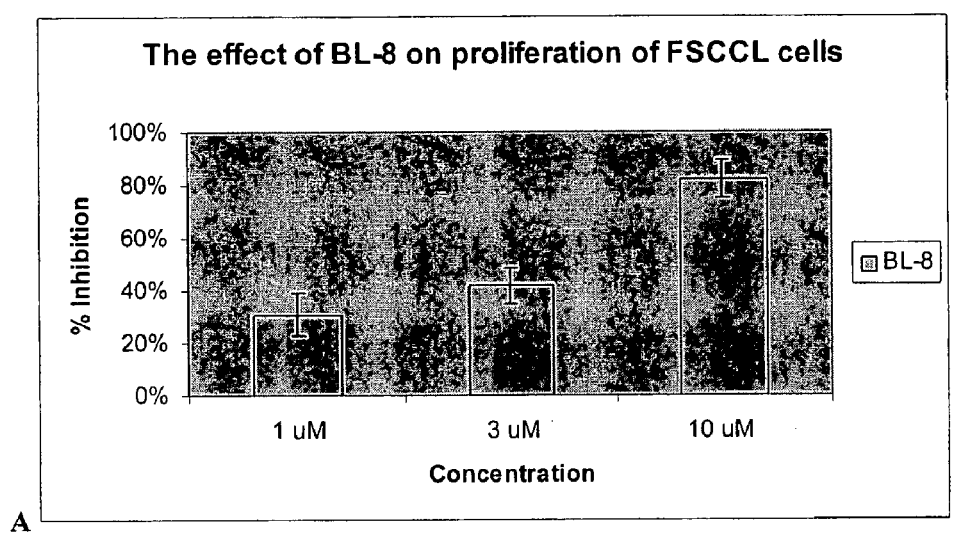
A
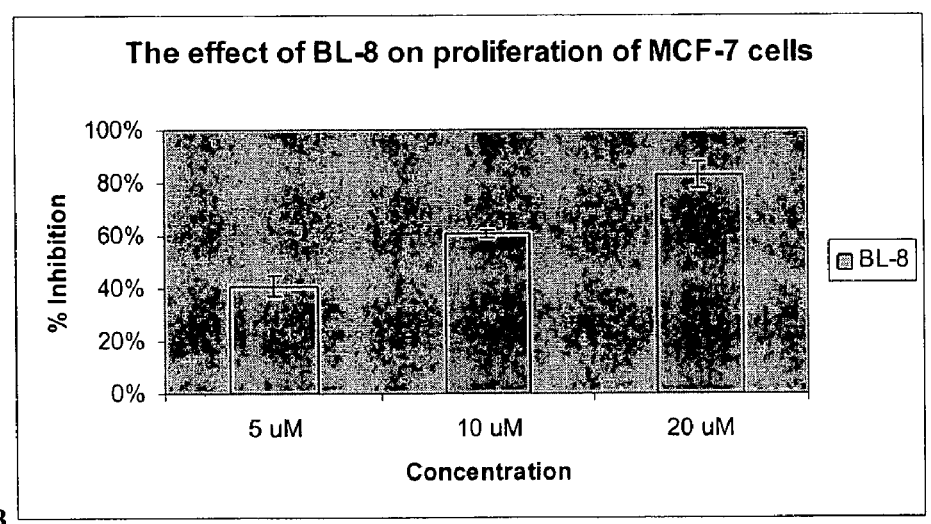
B

METHODS AND COMPOSITIONS FOR THE INHIBITION OF GENE EXPRESSION

A Sequence Listing has been submitted on a computer disc, the entire content of which is herein incorporated by reference. The compact disc and its duplicate are labeled Copy 1 Replacement Dec. 2, 2005 and Copy 2 Replacement Dec. 2, 2005, respectively. Each disk contains a file named "09054.txt" created on Dec. 2, 2005 that is 917,504 bytes.

FIELD OF THE INVENTION

The present invention relates to methods and compositions for the inhibition of gene expression. In particular, the present invention provides oligonucleotide-based therapeutics for the inhibition of oncogenes involved in cancers.

BACKGROUND OF THE INVENTION

Oncogenes have become the central concept in understanding cancer biology and may provide valuable targets for therapeutic drugs. All oncogenes and their products operate inside the cell. This makes protein-based drugs ineffective since their specificity involves ligand-receptor recognition.

Antisense oligodeoxyribonucleotides (oligonucleotides) are under investigation of therapeutic compound for specifically targeting oncogenes (Wickstrom, E. (ed). Prospects for antisense nucleic acid therapy of cancer and Aids. New York: Wiley-Liss, Inc. 1991; Murray, J. A. H. (ed). Antisense RNA and DNA New York: Wiley-Liss, Inc. 1992). Antisense drugs are modified synthetic oligonucleotides that work by interfering with ribosomal translation of the target mRNA. The antisense drugs developed thus far destroy the targeted mRNA by binding to it and triggering ribonuclease H (RNase H) degradation of mRNA. Oligonucleotides have a half-life of about 20 minutes and they are therefore rapidly degraded in most cells (Fisher, T. L. et al., Nucleic Acids Res. 21:3857-3865 (1993)). To increase the stability of oligonucleotides, they are often chemically modified, e.g., they are protected by a sulfur replacing one of the phosphate oxygens in the backbone (phosphorothioate) (Milligan, J. F. et al., J. Med. Chem. 36:1923-1937 (1993); Wagner, R. W. et al., Science 260: 1510-1513 (1993)). However, this modification can only slow the degradation of antisense and therefore large dosages of antisense drug are required to be effective.

Despite the optimism surrounding the use of antisense therapies, there are a number of serious problems with the use of antisense drugs such as difficulty in getting a sufficient amount of antisense into the cell, non-sequence-specific effects, toxicity due to the large amount of sulfur containing phosphothioates oligonucleotides and their inability to get into their target cells, and high cost due to continuous delivery of large doses. An additional problem with antisense drugs has been their nonspecific activities.

What is needed are additional non-protein based cancer therapeutics that target oncogenes. Therapeutics that are effective in low doses and that are non-toxic to the subject are particularly needed.

SUMMARY OF THE INVENTION

The present invention relates to methods and compositions for the inhibition of gene expression. In particular, the present invention provides oligonucleotide-based therapeutics for the inhibition of oncogenes involved in cancers.

In some embodiments, the present invention provides a composition comprising a first oligonucleotide that hybridizes to the promoter region of a c-myc gene under physiological conditions (e.g., SEQ ID NOs: 110, 111, 112, 113, 114 or 115). In some embodiments, at least one (e.g., all) of the cytosine bases in the first oligonucleotide is 5-methylcytosine. In some preferred embodiments, the hybridization of the first oligonucleotide to the promoter region of a c-myc gene inhibits expression of the c-myc gene. In some embodiments, the c-myc gene is on a chromosome of a cell, and the hybridization of the first oligonucleotide to the promoter region of the c-myc gene reduces proliferation of the cell. In some embodiments, the composition further comprises a second oligonucleotide. In some embodiments, at least one (e.g., all) of the cytosine bases in the second oligonucleotide are 5-methylcytosine. In some embodiments, the second oligonucleotide comprises SEQ ID NOs: 110, 111, 112, 113, 114 or 115, wherein the second oligonucleotide is different from the first oligonucleotide (e.g., if the second oligonucleotide has the sequence of SEQ ID NO: 110, the first oligonucleotide has a sequence other than SEQ ID NO: 110, etc.). In some embodiments, the second oligonucleotide hybridizes to a promoter region of a second gene, wherein the second gene is not c-myc. In some embodiments, the second gene is an oncogene (e.g., c-ki-Ras, c-Ha-Ras, bcl-2, Her-2, or TGF-α).

The present invention further provides a composition comprising an oligonucleotide that hybridizes to a promoter region of a c-myc gene at a position comprising between nucleotides 3-124 of SEQ ID NO:108 or between nucleotides 165-629 of SEQ ID NO:108.

The present invention further provides a method, comprising: providing an oligonucleotide that hybridizes to the promoter region of a c-myc gene under physiological conditions (e.g., SEQ ID NOs: 110, 111, 112, 113, 114 or 115); and a cell comprising a c-myc gene capable of expressing the c-myc gene, and wherein the cell is capable of proliferation; and introducing the oligonucleotide to the cell. In some embodiments, the introducing results in the reduction of proliferation of the cell. In certain embodiments, the introducing results in inhibition of expression of the c-myc gene. In some embodiments, the cell is a cancer cell. In other embodiments, the cell is in a host animal (e.g., a non-human mammal or a human). In some embodiments, the oligonucleotide is introduced to the host animal at a dosage of between 0.01 μg to 100 g, and preferably at a dosage of between 1 mg to 100 mg per kg of body weight. In some embodiments, the oligonucleotide is introduced to the host animal one or more times per day. In other embodiments, the oligonucleotide is introduced to the host animal continuously. In still further embodiments, the cell is in cell culture. In some embodiments, the method further comprises the step of introducing a test compound to the cell. In some embodiments, the test compound is a known chemotherapy agent. In some embodiments, the cancer is pancreatic cancer, colon cancer, breast cancer, bladder cancer, lung cancer, leukemia, prostate, lymphoma, ovarian, or melanoma.

In some embodiments, the method further provides a drug delivery system. In some embodiments, the drug delivery system comprises a liposome (e.g., a liposome comprising a neutral lipid or a lipid like compound). In some embodiments, the drug delivery system comprises a cell targeting component (e.g., a ligand or ligand like molecule for a cell surface receptor or a nuclear receptor). In certain embodiments, the drug delivery system is for use in vivo, and the oligonucleotide and the liposome are present in the ratio of from 2:1 to 1:3/1 μg to 100 mg per kg body weight.

In some embodiments, at least one, and preferably all, of the cytosine bases in the oligonucleotide are 5-methylcytosine. In some embodiments, the oligonucleotide is between 10 nucleotides and 60, and preferably between 15 and 35 nucleotides in length. In some embodiments, the oligonucleotide hybridizes to a promoter region of a c-myc gene at a position comprising between nucleotides 3-124 of SEQ ID NO:108 or between nucleotides 165-629 of SEQ ID NO:108.

In still further embodiments, the present invention provides a composition comprising an oligonucleotide that hybridizes under physiological conditions to the promoter region of a c-myc gene, the oligonucleotide comprising at least on CG dinucleotide pair, wherein at least one of the cytosine bases in the CG dinucleotide pair comprises 5-methylcytosine. In some embodiments, the oligonucleotide is completely complementary to the promoter region of the c-myc gene. In other embodiments, the oligonucleotide is partially complementary to the promoter region of the c-myc gene. For example, in certain embodiments, the oligonucleotide contains one mismatch to the promoter region of the c-myc gene. In some preferred embodiments, the oligonucleotide is complementary only to the promoter region of the c-myc gene and is not completely complementary to other regions of the human genome. In some embodiments, the oligonucleotide is between 10 nucleotides and 60, and preferably between 15 and 35 nucleotides in length.

The present invention further provides a composition comprising an oligonucleotide that hybridizes under physiological conditions to the promoter region of a c-myc gene under conditions such that expression of the c-myc gene is inhibited.

The present invention additionally provides a composition comprising an oligonucleotide that hybridizes under physiological conditions to the promoter region of a c-myc gene located on a chromosome of a cell under conditions such that proliferation of the cell is reduced.

The present invention also provides a composition comprising a first oligonucleotide that hybridizes under physiological conditions to the promoter region of a c-myc gene, the oligonucleotide comprising at least on CG dinucleotide pair, wherein at least one of the cytosine bases in the CG dinucleotide pair comprises 5-methylcytosine; and a second oligonucleotide, the second oligonucleotide comprising at least on CG dinucleotide pair, wherein at least one of the cytosine bases in the CG dinucleotide pair comprises 5-methylcytosine.

In certain embodiments, the present invention provides a kit comprising an oligonucleotide that hybridizes under physiological conditions to the promoter region of a c-myc gene, the oligonucleotide comprising at least on CG dinucleotide pair, wherein at least one of the cytosine bases in the CG dinucleotide pair comprises 5-methylcytosine; and instructions for using the kit for reducing proliferation of a cell comprising a c-myc gene on a chromosome of the cell or inhibiting gene expression. In some embodiments, the composition in the kit are used for treating cancer in a subject and the instructions comprise instructions for using the kit to treat cancer in the subject. In some embodiments, the instructions are instructions required by the U.S. Food and Drug Agency for labeling of pharmaceuticals.

The present invention also provides a method, comprising: providing a biological sample from a subject diagnosed with a cancer; and reagents for detecting the present or absence of expression of a oncogene in the sample; and detecting the presence or absence of expression of an oncogene in the sample; administering an oligonucleotide that hybridizes under physiological conditions to the promoter region of an oncogene expressed in the biological sample, the oligonucleotide comprising at least on CG dinucleotide pair, wherein at least one of the cytosine bases in the CG dinucleotide pair comprises 5-methylcytosine to the subject.

The present invention additionally provides a method of inhibiting the expression of a gene in a subject (e.g., for the treatment of cancer or other hyperproliferative disorders) comprising providing an oligonucleotide that hybridizes under physiological conditions to the promoter region of a gene involved in cancer or a hyperproliferative disorder expressed in the biological sample, the oligonucleotide comprising at least on CG dinucleotide pair, wherein at least one of the cytosine bases in the CG dinucleotide pair comprises 5-methylcytosine; and administering the oligonucleotide to the subject under conditions such that expression of the gene is inhibited. In some embodiments, the subject is a human.

In yet further embodiments, the present invention provides a method of screening compounds comprising providing a cell comprising a suspected oncogene; and an oligonucleotide that hybridizes to the promoter region of the gene; and administering the oligonucleotide to the cell; and determining if proliferation of the cell is inhibited in the presence of the oligonucleotide relative to the absence of the oligonucleotide. In some embodiments, the cell is in culture (e.g., a cancer cell line). In other embodiments, the cell is in a host animal (e.g., a non-human mammal). In some embodiments, the method is a high-throughput screening method.

DESCRIPTION OF THE FIGURES

FIG. 1 shows the nucleic acid sequence of the bcl-2 gene (SEQ ID NO:1).

FIG. 2 shows the sequences of antigenes to bcl-2 used in some embodiments of the present invention. X refers to a methylated C nucleotide.

FIG. 3 shows the nucleic acid sequence of the c-erbB-2 (Her-2) gene (SEQ ID NO:29).

FIG. 4 shows the sequences of antigenes to c-erbB-2 used in some embodiments of the present invention. X refers to a methylated C nucleotide.

FIG. 5 shows the nucleic acid sequence of the c-ki-Ras gene (SEQ ID NO:46).

FIG. 6 shows the sequences of antigenes to c-ki-Ras used in some embodiments of the present invention. X refers to a methylated C nucleotide.

FIG. 7 shows the nucleic acid sequence of the c-Ha-Ras gene (SEQ ID NO:66).

FIG. 8 shows the sequences of antigenes to c-Ha-Ras used in some embodiments of the present invention. X refers to a methylated C nucleotide.

FIG. 9 shows the nucleic acid sequence of the c-myc gene (SEQ ID NO:108).

FIG. 10 shows the sequences of antigenes to c-myc used in some embodiments of the present invention. X refers to a methylated C nucleotide.

FIG. 11 shows the nucleic acid sequence of the TGF-α gene (SEQ ID NO:131).

FIG. 12 shows the sequences of antigenes to TGF-α used in some embodiments of the present invention. X refers to a methylated C nucleotide.

FIG. 13 shows the inhibition of expression of cell growth by antigenes to c-ki-Ras used in some embodiments of the present invention FIG. 14 shows the inhibition of expression of cell growth by antigenes to bcl-2 used in some embodiments of the present invention.

FIG. 15 shows the inhibition of expression of cell growth by antigenes to c-erb-2 used in some embodiments of the present invention.

FIG. 16 shows the inhibition of expression of cell growth by antigenes to c-Ha-Ras used in some embodiments of the present invention.

FIG. 17 shows the inhibition of expression of cell growth by antigenes to c-myc used in some embodiments of the present invention.

FIG. 18 shows the inhibition of expression of cell growth by antigenes to TGF-α used in some embodiments of the present invention.

FIG. 20 shows the dose response curve of inhibition of expression of cell growth of FSCCL cells (A) and MCF-7 cells (B) by antigenes to bcl-2.

DEFINITIONS

Figure 19:
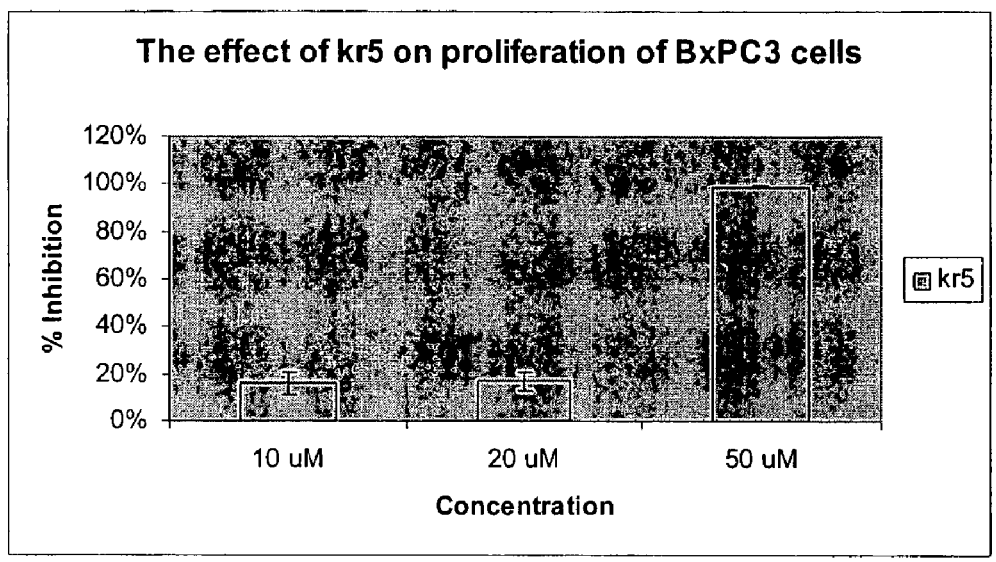
FIG. 19 shows the dose response curve of inhibition of expression of cell growth by antigenes to c-ki-Ras.

To facilitate an understanding of the present invention, a number of terms and phrases are defined below:

As used herein, the term "under conditions such that expression of said gene is inhibited" refers to conditions where an oligonucleotide of the present invention hybridizes to a gene (e.g., the promoter region of the gene) and inhibits transcription of the gene by at least 10%, preferably at least 25%, even more preferably at least 50%, and still more preferably at least 90% relative to the level of transcription in the absence of the oligonucleotide. The present invention is not limited to the inhibition of expression of a particular gene. Exemplary genes include, but are not limited to, c-ki-Ras, c-Ha-ras, c-myc, her-2, TGF-α, and bcl-2.

As used herein, the term "under conditions such that growth of said cell is reduced" refers to conditions where an oligonucleotide of the present invention, when administered to a cell (e.g., a cancer) reduces the rate of growth of the cell by at least 10%, preferably at least 25%, even more preferably at least 50%, and still more preferably at least 90% relative to the rate of growth of the cell in the absence of the oligonucleotide.

The term "epitope" as used herein refers to that portion of an antigen that makes contact with a particular antibody.

When a protein or fragment of a protein is used to immunize a host animal, numerous regions of the protein may induce the production of antibodies which bind specifically to a given region or three-dimensional structure on the protein; these regions or structures are referred to as "antigenic determinants". An antigenic determinant may compete with the intact antigen (i.e., the "immunogen" used to elicit the immune response) for binding to an antibody.

As used herein, the term "subject" refers to any animal (e.g., a mammal), including, but not limited to, humans, non-human primates, rodents, and the like, which is to be the recipient of a particular treatment. Typically, the terms "subject" and "patient" are used interchangeably herein in reference to a human subject.

As used herein, the terms "computer memory" and "computer memory device" refer to any storage media readable by a computer processor. Examples of computer memory include, but are not limited to, RAM, ROM, computer chips, digital video disc (DVDs), compact discs (CDs), hard disk drives (HDD), and magnetic tape.

As used herein, the term "computer readable medium" refers to any device or system for storing and providing information (e.g., data and instructions) to a computer processor. Examples of computer readable media include, but are not limited to, DVDs, CDs, hard disk drives, magnetic tape and servers for streaming media over networks.

As used herein, the terms "processor" and "central processing unit" or "CPU" are used interchangeably and refer to a device that is able to read a program from a computer memory (e.g., ROM or other computer memory) and perform a set of steps according to the program.

As used herein, the term "non-human animals" refers to all non-human animals including, but not limited to, vertebrates such as rodents, non-human primates, ovines, bovines, ruminants, lagomorphs, porcines, caprines, equines, canines, felines, aves, etc. and non-vertebrate animals such as drosophila and nematode. In some embodiments, "non-human animals" further refers to prokaryotes and viruses such as bacterial pathogens, viral pathogens.

As used herein, the term "nucleic acid molecule" refers to any nucleic acid containing molecule, including but not limited to, DNA or RNA. The term encompasses sequences that include any of the known base analogs of DNA and RNA including, but not limited to, 4-acetylcytosine, 8-hydroxy-N6-methyladenosine, aziridinylcytosine, pseudoisocytosine, 5-(carboxyhydroxylmethyl) uracil, 5-fluorouracil, 5-bromouracil, 5-carboxymethylaminomethyl-2-thiouracil, 5-carboxymethylaminomethyluracil, dihydrouracil, inosine, N6-isopentenyladenine, 1-methyladenine, 1-methylpseudouracil, 1-methylguanine, 1-methylinosine, 2,2-dimethylguanine, 2-methyladenine, 2-methylguanine, 3-methylcytosine, 5-methylcytosine, N6-methyladenine, 7-methylguanine, 5-methylaminomethyluracil, 5-methoxyaminomethyl-2-thiouracil, beta-D-mannosylqueosine, 5'-methoxycarbonylmethyluracil, 5-methoxyuracil, 2-methylthio-N6-isopentenyladenine, uracil-5-oxyacetic acid methylester, uracil-5-oxyacetic acid, oxybutoxosine, pseudouracil, queosine, 2-thiocytosine, 5-methyl-2-thiouracil, 2-thiouracil, 4-thiouracil, 5-methyluracil, N-uracil-5-oxyacetic acid methylester, uracil-5-oxyacetic acid, pseudouracil, queosine, 2-thiocytosine, and 2,6-diaminopurine.

The term "gene" refers to a nucleic acid (e.g., DNA) sequence that comprises coding sequences necessary for the production of a polypeptide, precursor, or RNA (e.g., rRNA, tRNA). The polypeptide can be encoded by a full length coding sequence or by any portion of the coding sequence so long as the desired activity or functional properties (e.g., enzymatic activity, ligand binding, signal transduction, immunogenicity, etc.) of the full-length or fragment are retained. The term also encompasses the coding region of a structural gene and the sequences located adjacent to the coding region on both the 5' and 3' ends for a distance of about 1 kb or more on either end such that the gene corresponds to the length of the full-length mRNA. Sequences located 5' of the coding region and present on the mRNA are referred to as 5' non-translated sequences. Sequences located 3' or downstream of the coding region and present on the mRNA are referred to as 3' non-translated sequences. The term "gene" encompasses both cDNA and genomic forms of a gene. A genomic form or clone of a gene contains the coding region interrupted with non-coding sequences termed "introns" or "intervening regions" or "intervening sequences." Introns are segments of a gene that are transcribed into nuclear RNA (hnRNA); introns may contain regulatory elements such as enhancers. Introns are removed or "spliced out" from the nuclear or primary transcript; introns therefore are absent in the messenger RNA (mRNA) transcript. The mRNA functions during translation to specify the sequence or order of amino acids in a nascent polypeptide.

As used herein, the term "heterologous gene" refers to a gene that is not in its natural environment. For example, a heterologous gene includes a gene from one species introduced into another species. A heterologous gene also includes a gene native to an organism that has been altered in some way (e.g., mutated, added in multiple copies, linked to non-native regulatory sequences, etc). Heterologous genes are distinguished from endogenous genes in that the heterologous gene sequences are typically joined to DNA sequences that are not found naturally associated with the gene sequences in the chromosome or are associated with portions of the chromosome not found in nature (e.g., genes expressed in loci where the gene is not normally expressed).

As used herein, the term "gene expression" refers to the process of converting genetic information encoded in a gene into RNA (e.g., mRNA, rRNA, tRNA, or snRNA) through "transcription" of the gene (i.e., via the enzymatic action of an RNA polymerase), and for protein encoding genes, into protein through "translation" of mRNA. Gene expression can be regulated at many stages in the process. "Up-regulation" or "activation" refers to regulation that increases the production of gene expression products (i.e., RNA or protein), while "down-regulation" or "repression" refers to regulation that decrease production. Molecules (e.g., transcription factors) that are involved in up-regulation or down-regulation are often called "activators" and "repressors," respectively.

In addition to containing introns, genomic forms of a gene may also include sequences located on both the 5' and 3' end of the sequences that are present on the RNA transcript. These sequences are referred to as "flanking" sequences or regions (these flanking sequences are located 5' or 3' to the non-translated sequences present on the mRNA transcript). The 5' flanking region may contain regulatory sequences such as promoters and enhancers that control or influence the transcription of the gene. The 3' flanking region may contain sequences that direct the termination of transcription, post-transcriptional cleavage and polyadenylation.

The term "wild-type" refers to a gene or gene product isolated from a naturally occurring source. A wild-type gene is that which is most frequently observed in a population and is thus arbitrarily designed the "normal" or "wild-type" form of the gene. In contrast, the term "modified" or "mutant" refers to a gene or gene product that displays modifications in sequence and or functional properties (i.e., altered characteristics) when compared to the wild-type gene or gene product. It is noted that naturally occurring mutants can be isolated; these are identified by the fact that they have altered characteristics (including altered nucleic acid sequences) when compared to the wild-type gene or gene product.

As used herein, the terms "nucleic acid molecule encoding," "DNA sequence encoding," and "DNA encoding" refer to the order or sequence of deoxyribonucleotides along a strand of deoxyribonucleic acid. The order of these deoxyribonucleotides determines the order of amino acids along the polypeptide (protein) chain. The DNA sequence thus codes for the amino acid sequence.

As used herein, the terms "an oligonucleotide having a nucleotide sequence encoding a gene" and "polynucleotide having a nucleotide sequence encoding a gene," means a nucleic acid sequence comprising the coding region of a gene or in other words the nucleic acid sequence that encodes a gene product. The coding region may be present in a cDNA, genomic DNA or RNA form. When present in a DNA form, the oligonucleotide or polynucleotide may be single-stranded (i.e., the sense strand) or double-stranded. Suitable control elements such as enhancers/promoters, splice junctions, polyadenylation signals, etc. may be placed in close proximity to the coding region of the gene if needed to permit proper initiation of transcription and/or correct processing of the primary RNA transcript. Alternatively, the coding region utilized in the expression vectors of the present invention may contain endogenous enhancers/promoters, splice junctions, intervening sequences, polyadenylation signals, etc. or a combination of both endogenous and exogenous control elements.

As used herein, the term "oligonucleotide," refers to a short length of single-stranded polynucleotide chain. Oligonucleotides are typically less than 200 residues long (e.g., between 8 and 100), however, as used herein, the term is also intended to encompass longer polynucleotide chains (e.g., as large as 5000 residues). Oligonucleotides are often referred to by their length. For example a 24 residue oligonucleotide is referred to as a "24-mer". Oligonucleotides can form secondary and tertiary structures by self-hybridizing or by hybridizing to other polynucleotides. Such structures can include, but are not limited to, duplexes, hairpins, cruciforms, bends, and triplexes.

In some embodiments, oligonucleotides are "antigenes." As used herein, the term "antigene" refers to an oligonucleotide that hybridizes to the promoter region of a gene. In some embodiments, the hybridization of the antigene to the promoter inhibits expression of the gene.

As used herein, the terms "complementary" or "complementarity" are used in reference to polynucleotides (i.e., a sequence of nucleotides) related by the base-pairing rules. For example, for the sequence "A-G-T," is complementary to the sequence "T-C-A." Complementarity may be "partial," in which only some of the nucleic acids' bases are matched according to the base pairing rules. Or, there may be "complete" or "total" complementarity between the nucleic acids. The degree of complementarity between nucleic acid strands has significant effects on the efficiency and strength of hybridization between nucleic acid strands. This is of particular importance in amplification reactions, as well as detection methods that depend upon binding between nucleic acids.

As used herein, the term "completely complementary," for example when used in reference to an oligonucleotide of the present invention refers to an oligonucleotide where all of the nucleotides are complementary to a target sequence (e.g., a gene).

As used herein, the term "partially complementary," for example when used in reference to an oligonucleotide of the present invention, refers to an oligonucleotide where at least one nucleotide is not complementary to the target sequence. Preferred partially complementary oligonucleotides are those that can still hybridize to the target sequence under physiological conditions. The term "partially complementary" refers to oligonucleotides that have regions of one or more non-complementary nucleotides both internal to the oligonucleotide or at either end. Oligonucleotides with mismatches at the ends may still hybridize to the target sequence.

The term "homology" refers to a degree of complementarity. There may be partial homology or complete homology (i.e., identity). A partially complementary sequence is a nucleic acid molecule that at least partially inhibits a completely complementary nucleic acid molecule from hybridizing to a target nucleic acid is "substantially homologous." The inhibition of hybridization of the completely complementary sequence to the target sequence may be examined using a hybridization assay (Southern or Northern blot, solution hybridization and the like) under conditions of low stringency. A substantially homologous sequence or probe will compete for and inhibit the binding (i.e., the hybridization) of a completely homologous nucleic acid molecule to a target under conditions of low stringency. This is not to say that conditions of low stringency are such that non-specific binding is permitted; low stringency conditions require that the binding of two sequences to one another be a specific (i.e., selective) interaction. The absence of non-specific binding may be tested by the use of a second target that is substantially non-complementary (e.g., less than about 30% identity); in the absence of non-specific binding the probe will not hybridize to the second non-complementary target.

When used in reference to a double-stranded nucleic acid sequence such as a cDNA or genomic clone, the term "substantially homologous" refers to any probe that can hybridize to either or both strands of the double-stranded nucleic acid sequence under conditions of low stringency as described above.

A gene may produce multiple RNA species that are generated by differential splicing of the primary RNA transcript. cDNAs that are splice variants of the same gene will contain regions of sequence identity or complete homology (representing the presence of the same exon or portion of the same exon on both cDNAs) and regions of complete non-identity (for example, representing the presence of exon "A" on cDNA 1 wherein cDNA 2 contains exon "B" instead). Because the two cDNAs contain regions of sequence identity they will both hybridize to a probe derived from the entire gene or portions of the gene containing sequences found on both cDNAs; the two splice variants are therefore substantially homologous to such a probe and to each other.

When used in reference to a single-stranded nucleic acid sequence, the term "substantially homologous" refers to any probe that can hybridize (i.e., it is the complement of) the single-stranded nucleic acid sequence under conditions of low stringency as described above.

As used herein, the term "hybridization" is used in reference to the pairing of complementary nucleic acids. Hybridization and the strength of hybridization (i.e., the strength of the association between the nucleic acids) is impacted by such factors as the degree of complementary between the nucleic acids, stringency of the conditions involved, the $T_m$ of the formed hybrid, and the G:C ratio within the nucleic acids. A single molecule that contains pairing of complementary nucleic acids within its structure is said to be "self-hybridized."

As used herein, the term "$T_m$" is used in reference to the "melting temperature." The melting temperature is the temperature at which a population of double-stranded nucleic acid molecules becomes half dissociated into single strands. The equation for calculating the $T_m$ of nucleic acids is well known in the art. As indicated by standard references, a simple estimate of the $T_m$ value may be calculated by the equation: $T_m=81.5+0.41(\% \text{ G+C})$, when a nucleic acid is in aqueous solution at 1 M NaCl (See e.g., Anderson and Young, Quantitative Filter Hybridization, in Nucleic Acid Hybridization [1985]). Other references include more sophisticated computations that take structural as well as sequence characteristics into account for the calculation of $T_m$.

As used herein the term "stringency" is used in reference to the conditions of temperature, ionic strength, and the presence of other compounds such as organic solvents, under which nucleic acid hybridizations are conducted. Under "low stringency conditions" a nucleic acid sequence of interest will hybridize to its exact complement, sequences with single base mismatches, closely related sequences (e.g., sequences with 90% or greater homology), and sequences having only partial homology (e.g., sequences with 50-90% homology). Under "medium stringency conditions," a nucleic acid sequence of interest will hybridize only to its exact complement, sequences with single base mismatches, and closely relation sequences (e.g., 90% or greater homology). Under "high stringency conditions," a nucleic acid sequence of interest will hybridize only to its exact complement, and (depending on conditions such a temperature) sequences with single base mismatches. In other words, under conditions of high stringency the temperature can be raised so as to exclude hybridization to sequences with single base mismatches.

"High stringency conditions" when used in reference to nucleic acid hybridization comprise conditions equivalent to binding or hybridization at 42° C. in a solution consisting of 5×SSPE (43.8 g/l NaCl, 6.9 g/l NaH$_2$PO$_4$ H$_2$O and 1.85 g/l EDTA, pH adjusted to 7.4 with NaOH), 0.5% SDS, 5× Denhardt's reagent and 100 µg/ml denatured salmon sperm DNA followed by washing in a solution comprising 0.1×SSPE, 1.0% SDS at 42° C. when a probe of about 500 nucleotides in length is employed.

"Medium stringency conditions" when used in reference to nucleic acid hybridization comprise conditions equivalent to binding or hybridization at 42° C. in a solution consisting of 5×SSPE (43.8 g/l NaCl, 6.9 g/l NaH$_2$PO$_4$ H$_2$O and 1.85 g/l EDTA, pH adjusted to 7.4 with NaOH), 0.5% SDS, 5× Denhardt's reagent and 100 µg/ml denatured salmon sperm DNA followed by washing in a solution comprising 1.0×SSPE, 1.0% SDS at 42° C. when a probe of about 500 nucleotides in length is employed.

"Low stringency conditions" comprise conditions equivalent to binding or hybridization at 42° C. in a solution consisting of 5×SSPE (43.8 g/l NaCl, 6.9 g/l NaH$_2$PO$_4$ H$_2$O and 1.85 g/l EDTA, pH adjusted to 7.4 with NaOH), 0.1% SDS, 5× Denhardt's reagent [50× Denhardt's contains per 500 ml: 5 g Ficoll (Type 400, Pharmacia), 5 g BSA (Fraction V; Sigma)] and 100 µg/ml denatured salmon sperm DNA followed by washing in a solution comprising 5×SSPE, 0.1% SDS at 42° C. when a probe of about 500 nucleotides in length is employed.

The present invention is not limited to the hybridization of probes of about 500 nucleotides in length. The present invention contemplates the use of probes between approximately 8 nucleotides up to several thousand (e.g., at least 5000) nucleotides in length. One skilled in the relevant understands that stringency conditions may be altered for probes of other sizes (See e.g., Anderson and Young, Quantitative Filter Hybridization, in *Nucleic Acid Hybridization* [1985] and Sambrook et al., Molecular Cloning: A Laboratory Manual, Cold Spring Harbor Press, NY [1989]).

The art knows well that numerous equivalent conditions may be employed to comprise low stringency conditions; factors such as the length and nature (DNA, RNA, base composition) of the probe and nature of the target (DNA, RNA, base composition, present in solution or immobilized, etc.) and the concentration of the salts and other components (e.g., the presence or absence of formamide, dextran sulfate, polyethylene glycol) are considered and the hybridization solution may be varied to generate conditions of low stringency hybridization different from, but equivalent to, the above listed conditions. In addition, the art knows conditions that promote hybridization under conditions of high stringency (e.g., increasing the temperature of the hybridization and/or wash steps, the use of formamide in the hybridization solution, etc.) (see definition above for "stringency").

As used herein, the term "physiological conditions" refers to specific stringency conditions that approximate or are conditions inside an animal (e.g., a human). Exemplary physiological conditions for use in vitro include, but are not limited to, 37° C., 95% air, 5% $CO_2$, commercial medium for culture of mammalian cells (e.g., DMEM media available from Gibco, Md.), 5-10% serum (e.g., calf serum or horse serum), additional buffers, and optionally hormone (e.g., insulin and epidermal growth factor).

The term "isolated" when used in relation to a nucleic acid, as in "an isolated oligonucleotide" or "isolated polynucleotide" refers to a nucleic acid sequence that is identified and separated from at least one component or contaminant with which it is ordinarily associated in its natural source. Isolated nucleic acid is such present in a form or setting that is different from that in which it is found in nature. In contrast, non-isolated nucleic acids as nucleic acids such as DNA and RNA found in the state they exist in nature. For example, a given DNA sequence (e.g., a gene) is found on the host cell chromosome in proximity to neighboring genes; RNA sequences, such as a specific mRNA sequence encoding a specific protein, are found in the cell as a mixture with numerous other mRNAs that encode a multitude of proteins. However, isolated nucleic acid encoding a given protein includes, by way of example, such nucleic acid in cells ordinarily expressing the given protein where the nucleic acid is in a chromosomal location different from that of natural cells, or is otherwise flanked by a different nucleic acid sequence than that found in nature. The isolated nucleic acid, oligonucleotide, or polynucleotide may be present in single-stranded or double-stranded form. When an isolated nucleic acid, oligonucleotide or polynucleotide is to be utilized to express a protein, the oligonucleotide or polynucleotide will contain at a minimum the sense or coding strand (i.e., the oligonucleotide or polynucleotide may be single-stranded), but may contain both the sense and anti-sense strands (i.e., the oligonucleotide or polynucleotide may be double-stranded).

As used herein, the term "purified" or "to purify" refers to the removal of components (e.g., contaminants) from a sample. For example, antibodies are purified by removal of contaminating non-immunoglobulin proteins; they are also purified by the removal of immunoglobulin that does not bind to the target molecule. The removal of non-immunoglobulin proteins and/or the removal of immunoglobulins that do not bind to the target molecule results in an increase in the percent of target-reactive immunoglobulins in the sample. In another example, recombinant polypeptides are expressed in bacterial host cells and the polypeptides are purified by the removal of host cell proteins; the percent of recombinant polypeptides is thereby increased in the sample. "Amino acid sequence" and terms such as "polypeptide" or "protein" are not meant to limit the amino acid sequence to the complete, native amino acid sequence associated with the recited protein molecule.

The term "native protein" as used herein to indicate that a protein does not contain amino acid residues encoded by vector sequences; that is, the native protein contains only those amino acids found in the protein as it occurs in nature. A native protein may be produced by recombinant means or may be isolated from a naturally occurring source.

As used herein the term "portion" when in reference to a protein (as in "a portion of a given protein") refers to fragments of that protein. The fragments may range in size from four amino acid residues to the entire amino acid sequence minus one amino acid.

The term "Southern blot," refers to the analysis of DNA on agarose or acrylamide gels to fractionate the DNA according to size followed by transfer of the DNA from the gel to a solid support, such as nitrocellulose or a nylon membrane. The immobilized DNA is then probed with a labeled probe to detect DNA species complementary to the probe used. The DNA may be cleaved with restriction enzymes prior to electrophoresis. Following electrophoresis, the DNA may be partially depurinated and denatured prior to or during transfer to the solid support. Southern blots are a standard tool of molecular biologists (J. Sambrook et al., Molecular Cloning: A Laboratory Manual, Cold Spring Harbor Press, NY, pp 9.31-9.58 [1989]).

The term "Northern blot," as used herein refers to the analysis of RNA by electrophoresis of RNA on agarose gels to fractionate the RNA according to size followed by transfer of the RNA from the gel to a solid support, such as nitrocellulose or a nylon membrane. The immobilized RNA is then probed with a labeled probe to detect RNA species complementary to the probe used. Northern blots are a standard tool of molecular biologists (J. Sambrook, et al., supra, pp 7.39-7.52 [1989]).

The term "Western blot" refers to the analysis of protein(s) (or polypeptides) immobilized onto a support such as nitrocellulose or a membrane. The proteins are run on acrylamide gels to separate the proteins, followed by transfer of the protein from the gel to a solid support, such as nitrocellulose or a nylon membrane. The immobilized proteins are then exposed to antibodies with reactivity against an antigen of interest. The binding of the antibodies may be detected by various methods, including the use of radiolabeled antibodies.

As used herein, the term "cell culture" refers to any in vitro culture of cells. Included within this term are continuous cell lines (e.g., with an immortal phenotype), primary cell cultures, transformed cell lines, finite cell lines (e.g., non-transformed cells), and any other cell population maintained in vitro.

As used, the term "eukaryote" refers to organisms distinguishable from "prokaryotes." It is intended that the term encompass all organisms with cells that exhibit the usual characteristics of eukaryotes, such as the presence of a true nucleus bounded by a nuclear membrane, within which lie the chromosomes, the presence of membrane-bound organelles, and other characteristics commonly observed in eukaryotic organisms. Thus, the term includes, but is not limited to such organisms as fungi, protozoa, and animals (e.g., humans).

As used herein, the term "in vitro" refers to an artificial environment and to processes or reactions that occur within an artificial environment. In vitro environments can consist of, but are not limited to, test tubes and cell culture. The term "in vivo" refers to the natural environment (e.g., an animal or a cell) and to processes or reaction that occur within a natural environment.

The terms "test compound" and "candidate compound" refer to any chemical entity, pharmaceutical, drug, and the like that is a candidate for use to treat or prevent a disease, illness, sickness, or disorder of bodily function (e.g., cancer). Test compounds comprise both known and potential therapeutic compounds. A test compound can be determined to be therapeutic by screening using the screening methods of the present invention. In some embodiments of the present invention, test compounds include antisense compounds.

As used herein, the term "known chemotherapeutic agents" refers to compounds known to be useful in the treatment of disease (e.g., cancer). Exemplary chemotherapeutic agents affective against cancer include, but are not limited to, daunorubicin, dactinomycin, doxorubicin, bleomycin, mitomycin, nitrogen mustard, chlorambucil, melphalan, cyclophosphamide, 6-mercaptopurine, 6-thioguanine, cytarabine (CA), 5-fluorouracil (5-FU), floxuridine (5-FUdR), methotrexate (MTX), colchicine, vincristine, vinblastine, etoposide, teniposide, cisplatin and diethylstilbestrol (DES).

As used herein, the term "sample" is used in its broadest sense. In one sense, it is meant to include a specimen or culture obtained from any source, as well as biological and environmental samples. Biological samples may be obtained from animals (including humans) and encompass fluids, solids, tissues, and gases. Biological samples include blood products, such as plasma, serum and the like. Environmental samples include environmental material such as surface matter, soil, water, crystals and industrial samples. Such examples are not however to be construed as limiting the sample types applicable to the present invention.

DETAILED DESCRIPTION OF THE INVENTION

The present invention relates to methods and compositions for the treatment of cancers. In particular, the present invention provides oligonucleotide-based therapeutics for the inhibition of oncogenes involved in a variety of cancers. The present invention is not limited to the treatment of a particular cancer. Any cancer can be targeted, including, but not limited to, breast cancers. The present invention is also not limited to the targeting of cancers or oncogenes. The methods and compositions of the present invention are suitable for use with any gene that it is desirable to inhibit the expression of (e.g., for therapeutic or research uses).

I. Oncogene Targets

In some embodiments, the present invention provides antigene inhibitors of oncogenes. The present invention is not limited to the inhibition of a particular oncogene. Indeed, the present invention encompasses antigene inhibitors to any number of oncogenes including, but not limited to, those disclosed herein.

A. Ras

One gene which has captured the attention of many scientists is the human proto-oncogene, c-Ha-ras. The nucleic acid sequence of the promoter region of c-H-ras is shown in FIG. 7. This gene acts as a central dispatcher, relaying chemical signals into cells and controlling cell division. Ras gene alteration may cause the gene to stay in the "on" position. The ras oncogene is believed to underlie up to 30% of cancer, including colon cancer, lung cancer, bladder and mammary carcinoma (Bos, Cancer Res. 49:4682-4689 [1989]). The ras oncogene has therefore become a target for therapeutic drugs.

There are several reports showing that oligonucleotides complementary to various sites of ras MRNA can inhibit synthesis of ras protein (p21), which decreases the cell proliferation rate in cell culture (U.S. Pat. Nos. 5,576,208; 5,582, 986; Daska et al., Oncogene Res. 5:267-275 [1990]; Brown et al., Oncogene Res. 4:243-252 [1989]; Saison-Behmoaras et al., EMBO J. 10:1111-1116 [1991)]. Oligonucleotides complementary to the 5' flanking region of the c-Ha-ras RNA transcript have shown to inhibit tumor growth in nude mice for up to 14 days (Gray et al., Cancer Res. 53:577-580 [1993]). It was recently reported that an antisense oligonucleotide directed to a point mutation (G>C) in codon 12 of the c-Ha-ras mRNA inhibited cell proliferation as well as tumor growth in nude mice when it was injected subcutaneously (U.S. Pat. Nos. 5,576,208; 5,582,986; Schwab et al., Proc. Natl. Acad. Sci. USA 91:10460-10464 [1994]; each of which is herein incorporated by reference). Researchers have also reported that antisense drugs shrank ovarian tumors in small clinical trials (Roush et al., Science 276:1192-1194 [1997]).

B. Her-2

The HER-2 (also known as neu oncogene or erbB-2) oncogene encodes a receptor-like tyrosine kinase (RTK) that has been extensively investigated because of its role in several human carcinomas (Hynes and Stem, Biochim. et Biophy. Acta 1198:165-184 [1994]; Dougall et al., Oncogene 9:2109-2123 [1994]) and in mammalian development (Lee et al., Nature 378:394-398 [1995]). The nucleic acid sequence of the promoter region of Her-2 is shown in FIG. 3. The sequence of the HER-2 protein was determined from a cDNA that was cloned by homology to the epidermal growth factor receptor (EGFR) mRNA from placenta (Coussens et al., Science 230:1132-1139 [1985]) and from a gastric carcinoma cell line (Yamamoto et al., Nature 319:230-234 [1986]). The HER-2 mRNA was shown to be about 4.5 kb (Coussens et al., Science 230:1132-1139 [1985]; Yamamoto et al., Nature 319: 230-234 [1986]) and encodes a transmembrane glycoprotein of 185 kDa in normal and malignant human tissues (p185HER-2) (Hynes and Steen, Biochim. et Biophys. Acta 1198:165-184 [1994]; Dougall et al., Oncogene 9:2109-2123 [1994]). Overexpression of HER-2 causes phenotypic transformation of cultured cells (DiFiore et al., Science 237:178-182 [1987]; Hudziak et al., Proc. Natl. Acad. Sci. USA 84:7159-7163 [1987]) and has been associated with aggressive clinical progression of breast and ovarian cancer (Slamon et al., Science 235:177-182 [1987]; Slamon et al., Science 244:707-712 [1989]).

HER-2 is one of the most frequently altered genes in cancer. It encodes a transmembrane receptor (also known as p185) with tyrosine kinase activity and is a member of the epidermal growth factor (EGF) family, and thus is related to the epidermal growth factor receptor (EGFR or HER-1). Aberrant HER-2 gene expression is present in a wide variety of cancers and are most common in breast, ovarian and gastric cancers. HER-2 is overexpressed in 25-30% of all human breast and ovarian cancers. Levels of HER-2 overexpression correlate well with clinical stage of breast cancer, prognosis and metastatic potential. Overexpression of HER-2 is associated with lower survival rates, increased relapse rates and increased metastatic potential. Tan et al., (Cancer Res., 57:1199 [1997]) have shown that overexpression of the HER-2 gene increases the metastatic potential of breast cancer cells without increasing their transformation ability.

Aberrant expression of HER-2 includes both increased expression of normal HER-2 and expression of mutant HER-2. Activation of the HER-2 proto-oncogene can occur by any of three mechanisms--point mutation, gene amplification and overexpression. Gene amplification is the most common mechanism. Unlike the other EGF family members for whom ligand activation is necessary for promoting transformation, overexpression of HER-2 alone is sufficient for transformation (Cohen, et al., J. Biol. Chem., 271:30897 [1996]).

Several therapeutic approaches have been used to reduce levels of the HER-2 gene product. The adenovirus type 5 gene product E1A has been studied as a potential therapeutic using a breast cancer model in nude mice. This gene product can repress HER-2/neu overexpression by repressing HER-2/neu promoter activity, and suppress the tumorigenic potential of HER-2/neu-overexpressing ovarian cancer cells. In mice bearing HER-2/neu-overexpressing breast cancer xenografts, E1A delivered either by adenovirus or liposome significantly inhibited tumor growth and prolonged mouse survival compared with the controls (Chang et al., Oncogene 14:561 [1997])

Clinical trials have been conducted to evaluate a bispecific antibody which targets the extracellular domains of both the HER-2/neu protein product and Fc gamma RIII (CD16), the Fc gamma receptor expressed by human natural killer cells, neutrophils, and differentiated mononuclear phagocytes (Weiner et al., J. Hematotherapy, 4:471 [1995]).

Overexpression of HER-2 has also been found to be associated with increased resistance to chemotherapy. Thus, patients with elevated levels of HER-2 respond poorly to many drugs. Methods used to inhibit HER-2 expression have been combined with commonly used chemotherapeutic agents (Ueno et al., Oncogone 15:953 [1997]). Combining the adenovirus type 5 gene product, E1A, with taxol showed a synergistic effect in human breast cancer cells. Zhang et al., (Oncogene, 12:571 [1996]) demonstrated that emodin, a tyrosine-specific inhibitor, sensitized non-small cell lung cancer (NSCLC) cells to a variety of chemotherapeutic drugs, including cisplatin, doxorubicin and etoposide. A HER-2 antibody was found to increase the efficacy of tamoxifen in human breast cancer cells (Witters et al., Breast Cancer Res. and Treatment, 42:1 [1997]).

Oligonucleotides have also been used to study the function of HER-2. A triplex-forming oligonucleotide targeted to the HER-2 promoter, 42 to 69 nucleotides upstream of the mRNA transcription start site was found to inhibit HER-2 expression in vitro (Ebbinghaus et al., J. Clin. Invest., 92:2433 [1993]). Porumb et al. (Cancer Res., 56:515 [1996]) also used a triplex-forming oligonucleotide targeted to the same HER-2 promoter region. Decreases in HER-2 mRNA and protein levels were seen in cultured cells. Juhl et al. (J. Biol. Chem., 272:29482 [1997]) used anti-HER-2 ribozymes targeted to a central region of the HER-2 RNA just downstream of the transmembrane region of the protein to demonstrate a reduction in HER-2 mRNA and protein levels in human ovarian cancer cells. A reduction in tumor growth in nude mice was also seen.

An antisense approach has been used as a potential therapeutic for HER-2 overexpressing cancers. Pegues et al. (Cancer Lett., 117:73 [1997]) cloned a 1.5 kb fragment of HER-2 in an antisense orientation into an expression vector; transfecting of this construct into ovarian cancer cells resulted in a reduction of anchorage-independent growth. Casalini et al. (Int. J. Cancer 72:631 [1997]) used several human HER-2 antisense vector constructs, containing HER-2 fragments from 151 bp to 415 bp in length, to demonstrate reduction in HER-2 protein levels and anchorage-independent growth in lung adenocarcinoma cells. Colomer et al. (Br. J. Cancer, 70:819 [1994]) showed that phosphodiester antisense oligonucleotides targeted at or immediately downstream of, the translation initiation codon inhibited proliferation of human breast cancer cells by up to 60%. Wiechen et al. (Int. J. Cancer 63:604 [1995]) demonstrated that an 18-nucleotide phosphorothioate oligonucleotide targeted to the coding region, 33 nucleotides downstream of the translation initiation codon, of HER-2 reduced anchorage-independent growth of ovarian cancer cells. Bertram et al. (Biochem. Biophys. Res. Commun., 200:661 [1994]) used antisense phosphorothioate oligonucleotides targeted to the translation initiation region and a sequence at the 3' part of the translated region of the MRNA which has high homology to a tyrosine kinase consensus sequence, and demonstrated a 75% reduction in HER-2 protein levels in human breast cancer cells. Liu et al., (Antisense and Nucleic Acid Drug Develop., 6:9 [1996]) used antisense phosphorothioate oligonucleotides targeted to the 5' cap site and coding region. The most effective oligonucleotide, targeted to the 5' cap site, reduced HER-2 protein expression by 90%. Cell proliferation was also reduced by a comparable amount. Vaughn et al. (Nuc. Acids. Res., 24:4558 [1996]) used phosphorothioate, phosphorodithioate and chimeric antisense oligonucleotides targeted at or adjacent to (either side) the translation initiation region of HER-2. An alternating dithioate/diester oligonucleotide targeted to the translation initiation region worked slightly better than an all phosphorothioate oligonucleotide. Brysch et al. (Cancer Gene Ther., 1: 99 [1994]) used chemically modified antisense oligonucleotides targeted to the translation initiation codon of HER-2 to reduce protein levels and cause growth arrest of human breast cancer cell line.

C. C-Myc

The c-myc gene product is encoded by an immediate early response gene, the expression of which can be induced by various mitogens. The nucleic acid sequence of the promoter region of the c-myc gene is shown in FIG. 9. C-myc expression is involved in the signal transduction pathways leading to cell division. Studies have demonstrated that proliferating cells have higher levels of c-myc mRNA and c-myc protein than do quiescent cells. Antibodies directed against the human c-myc protein are known to inhibit DNA synthesis in nuclei isolated from human cells. Conversely, constitutive expression of c-myc produced by gene transfer inhibits induced differentiation of several cell lines. Constitutive expression of c-myc predisposes transgenic mice to the development of tumors.

Some studies have suggested that the c-myc gene product may play a proliferative role in SMCs. Balloon de-endothelialization and injury of rat aortas is known to increase c-myc mRNA expression of vascular SMC prior to their subsequent proliferation and migration. Also, SMCs in culture proliferate when exposed to several mitogens, including PDGF, FGF, EGF, IGF-1 and to serum. Each of these mitogens has been found to be capable of increasing the expression in other cell lines of either c-myc protein, c-myc mRNA, or both. Additionally, blood serum has been found to increase c-myc mRNA levels in SMCs.

Harel-Bellan et al. (J. Immun. 140; 2431-2435 (1988)) demonstrated that antisense oligonucleotides complementary to c-myc mRNA effectively inhibited the translation thereof in human T cells. These T cells were prevented from entering the S phase of cell division. c-myc proto-oncogene sequences are described in Marcu et al., Ann. Rev. Biochem., 61:809-860 [1992]; Watt et al., Nature, 303:725-728 [1983)]; Battey et al., Cell, 34:779-787 (1983); and Epstein et al, NTIS publication PB93-100576

D. Bcl2

In many types of human tumors, including lymphomas and leukemias, the human bcl-2 gene is overexpressed, and may be associated with tumorigenicity (Tsujimoto et al., Science 228:1440-1443 [1985]). The nucleic acid sequence of the promoter region of bcl-2 is shown in FIG. 1. High levels of expression of the human bcl-2 gene have been found in all lymphomas with t (14; 18) chromosomal translocations including most follicular B cell lymphomas and many large cell non-Hodgkin's lymphomas. High levels of expression of the bcl-2 gene have also been found in certain leukemias that do not have a t(14; 18) chromosomal translation, including most cases of chronic lymphocytic leukemia acute, many lymphocytic leukemias of the pre-B cell type, neuroblastomas, nasophryngeal carcinomas, and many adenocarcinomas of the prostate, breast, and colon. (Reed et al., Cancer Res. 51:6529 [1991]; Yunis et al., New England J. Med. 320:1047; Campos et al., Blood 81:3091-3096 [1993]; McDonnell et al., Cancer Res. 52:6940-6944 [1992); Lu et al., Int. J Cancer 53:29-35 [1993]; Bonner et al., Lab Invest. 68:43A [1993]).

E. TGF-α

Transforming Growth Factor Alpha (TGF-α) is a polypeptide of 50 amino acids. The nucleic acid sequence of the TGF-α promoter is shown in FIG. 11. It was first isolated from a retrovirus-transformed mouse cell line and subsequently was identified in human tumor cells, in early rat embryo cells and in cell cultures from the human pituitary gland. TGF-α is closely related to Epidermal Growth Factor (EGF), both structurally and functionally, and both bind to the same receptor, i.e., Epidermal Growth Factor Receptor (EGFR).

The sequence and three dimensional structure of both EGF and TGF-α have been determined (Campbell et al., Prog. Growth Factor Res. 1:13 [1989]). TGF-α is a 50 amino acid polypeptide having about 40% homology of residues with EGF. Both peptides are characterized by three well defined loops (denoted A, B and C) and have three intramolecular disulphide bonds.

Several growth factors, including TGF-α and EGF, are believed to exert their biological effects via interaction with the Epidermal Growth Factor Receptor (EGF Receptor). The EGF Receptor is a Type 1 receptor tyrosine kinase. The EGF Receptor and its ligands are of interest for their roles in normal physiological processes as well as in hyperproliferative and neoplastic diseases.

The in vivo precursor of TGF-α is a 160 amino acid residue membrane-bound protein (pro-TGF-.alpha.) that is cleaved to yield a soluble compound (Massague, J. Biol. Chem., 265: 21393-21396 [1990]). This cleavage removes an extracellular portion comprised of 50 amino acids with a molecular weight of 6 Kd and is considered to be an important regulatory event (Pandiella et al., Proc. Natl. Acad. Sci. USA, 88:1726-1730 [1990]) that can be stimulated by phorbol esters acting via protein kinase C (Pandiella et al., J. Biol. Chem., 266:5769-5773 [1991]).

Cultured human prostatic tumor lines contain elevated levels of TGF-α mRNA and proliferate in response to TGF-α (Wilding et al., The Prostate, 15:1-12 [1989]). TGF-α appears to have both autocrine and paracrine function, stimulating physiologic activities such as cell division and angiogenesis. When induced in transgenic mice, TGF-α produced epithelial hyperplasia and focal dysplastic changes that resembled carcinoma in situ (Sandgren et al., Cell, 61:1121-1135 [1990]).

F. c-ki-RAS

The c-Ki-RAS (KRAS) oncogene is expressed ubiquitously. KRAS, with a length of more than 30 kb, is much larger than HRAS or NRAS. The sequence of the promoter region of c-ki-ras is shown in FIG. 5. Although the 3 ras genes, HRAS, KRAS, and NRAS, have different genetic structures, all code for proteins of 189 amino acid residues, generically designated p21. These genes acquire malignant properties by single point mutations that affect the incorporation of the 12th or 61st amino acid residue of their respective p21. KRAS is involved in malignancy much more often than is HRAS. In a study of 96 human tumors or tumor cell lines in the NIH 3T3 transforming system, (Pulciani et al., *Nature* 300: 539 (1982) found a mutated HRAS locus only in T24 bladder cancer cells, whereas transforming KRAS genes were identified in 8 different carcinomas and sarcomas.

In a serous cystadenocarcinoma of the ovary, Feig et al. (*Science* 223: 698 (1984)) showed the presence of an activated KRAS oncogene not activated in normal cells of the same patient. The transforming gene product displayed an electrophoretic mobility in SDS-polyacrylamide gels that differed from the mobility of KRAS transforming proteins in other tumors. Thus, a previously undescribed mutation was responsible for activation of KRAS in this ovarian carcinoma. To study the role of oncogenes in lung cancer, Rodenhuis et al. (*New Eng. J Med.* 317: 929 (1987)) used an assay based on oligonucleotide hybridization following an in vitro amplification step. Genomic DNA was examined from 39 tumor specimens obtained at thoracotomy. The KRAS gene was found to be activated by point mutations in codon 12 in 5 of 10 adenocarcinomas. Two of these tumors were less than 2 cm in size and had not metastasized. No HRAS, KRAS, or NRAS mutations were observed in 15 squamous cell carcinomas, 10 large cell carcinomas, 1 carcinoid, 2 metastatic adenocarcinomas from primary tumors outside the lung, and 1 small cell carcinoma. An approximately 20-fold amplification of the unmutated KRAS gene was observed in a tumor that proved to be a solitary lung metastasis of a rectal carcinoma. Yanez et al. (*Oncogene* 1:315 (1987)) found mutations in codon 12 of the KRAS gene in 4 of 16 colon cancers, 2 of 27 lung cancers, and 1 of 8 breast cancers; no mutations were found at position 61. Of the 6 possible amino acid replacements in codon 12, all but one were represented in the 7 mutations identified.

G. Other Oncogene Targets

The present invention is not limited to the oncogenes described above. The methods of the present invention are suitable for use with any oncogene with a known promoter region. Exemplary oncogenes included, but are not limited to, BCR/ABL, ABL1/BCR, ABL, BCL1, CD24, CDK4, EGFR/ERBB-1, HSTF1, INT1/WNT1, INT2, MDM2, MET, MYB, MYC, MYCN, MYCL1, RAFI, NRAS, REL, AKT2, APC, BCL2-ALPHA, BCL2-BETA, BCL3, BCR, BRCA1, BRCA2, CBL, CCND1, CDKN1A, CDKN1C, CDKN2A, CDKN2B, CRK, CRK-II, CSF1R/FMS, DBL, DDOST, DCC, DPC4/SMAD4, E-CAD, E2F1/RBAP, ELK1, ELK3, EPH, EPHA1, E2F1, EPHA3, ERG, ETS1, ETS2, FER, FGR, FLI1/ERGB2, FOS, FPS/FES, FRA1, FRA2, FYN, HCK, HEK, HER3/ERBB-2, ERBB-3, HER4/ERBB-4, HST2, INK4A, INK4B, JUN, JUNB, JUND, KIP2, KIT, KRAS2A, KRAS2B, LCK, LYN, MAS, MAX, MCC, MLH1, MOS, MSH2, MYBA, MYBB, NF1, NF2, P53, PDGFB, PIM1, PTC, RB1, RET, ROS1, SKI, SRC1, TAL1, TGFBR2, THRA1, THRB, TIAM1, TRK, VAV, VHL, WAF1, WNT2, WT1, YES1, ALK/NPM1, AMl1, AXL, FMS, GIP, GLI, GSP, HOX11, HST, IL3, INT2, KS3, K-SAM, LBC, LMO-1, LMO-2, L-MYC, LYL1, LYT-10, MDM-2, MLH1, MLL, MLM, N-MYC, OST, PAX-5, PMS-1, PMS-2, PRAD-1, RAF, RHOM-1, RHOM-2, SIS, TAL2, TAN1, TIAM1, TSC2, TRK, TSC1, STK11, PTCH, MEN1, MEN2, P57/KIP2, PTEN, HPC1, ATM, XPA/XPG, BCL6, DEK, AKAP13, CDH1, BLM, EWSR1/FLI1, FES, FGF3, FGF4, FGF6, FANCA, FLI1/ERGB2, FOSL1, FOSL2, GLI, HRAS1, HRX/MLLT1, HRX/MLLT2, KRAS2, MADH4, MAS1, MCF2, MLLT1/MLL, MLLT2/HRX, MTG8/RUNX1, MYCLK1, MYH11/CBFB, NFKB2, NOTCH1, NPM1/ALK, NRG/REL, NTRK1, PBX1/TCF3, PML/RARA, PRCA1, RUNX1, RUNX1/CBFA2T1, SET, TCF3/PBX1, TGFB1, TLX1, P53, WNT1, WNT2, WT1, αv-β3, PKCα, TNFα, Clusterin, Surviving, TGFβ, c-fos, c-SRC, and INT-1.

II. Non-Oncogene Targets

The present invention is not limited to the targeting of oncogenes. The methods and compositions of the present invention find use in the targeting of any gene that it is desirable to down regulate the expression of. For example, in some embodiments, the genes to be targeted include, but are not limited to, an immunoglobulin or antibody gene, a clotting factor gene, a protease, a pituitary hormone, a protease inhibitor, a growth factor, a somatomedian, a gonadotrophin, a chemotactin, a chemokine, a plasma protein, a plasma protease inhibitor, an interleukin, an interferon, a cytokine, a transcription factor, or a pathogen target (e.g., a viral gene, a bacterial gene, a microbial gene, a fungal gene).

Examples of specific genes include, but are not limited to, ADAMTS4, ADAMTS5, APOA1, APOE, APP, B2M, COX2, CRP, DDX25, DMC1, FKBP8, GH1, GHR, IAPP, IFNA1, IFNG, IL1, I110, IL12, IL13, IL2, IL4, IL7, IL8, IPW, MAPK14, Mei1, MMP13, MYD88, NDN, PACE4, PRNP, PSEN1, PSEN2, RAD51, RAD51C, SAP, SNRPN, TLR4, TLR9, TTR, UBE3A, VLA-4, and PTP-1B, c-RAF, m-TOR, LDL, VLDL, ApoB-100, HDL, VEGF, rhPDGF-BB, NADs, ICAM-1, MUC1, 2-dG, CTL, PSGL-1, E2F, NF-kB, HIF, and GCPRs.

In other embodiments and gene from a pathogen is targeted. Exemplary pathogens include, but are not limited to, Human Immunodeficiency virus, Hepatitis B virus, hepatitis C virus, hepatitis A virus, respiratory syncytial virus, pathogens involved in severe acute respiratory syndrome, west nile virus, and food borne pathogens (e.g., *E. coli*).

III. DNA Methylation

In some embodiments, the present invention provides oligonucleotide therapeutics that are methylated at specific sites. The present invention is not limited to a particular mechanism. Indeed, an understanding of the mechanism is not necessary to practice the present invention. Nonetheless, it is contemplated that one mechanism for the regulation of gene activity is methylation of cytosine residues in DNA. 5-methylcytosine (5-MeC) is the only naturally occurring modified base detected in DNA (Ehrlick et al., Science 212: 1350-1357 (1981)). Although not all genes are regulated by methylation, hypomethylation at specific sites or in specific regions in a number of genes is correlated with active transcription (Doerfler, Annu. Rev. Biochem. 52:93-124 [1984]; Christman, Curr. Top. Microbiol. Immunol. 108:49-78 [1988]; Cedar, Cell 34:5503-5513 [1988]). DNA methylation in vitro can prevent efficient transcription of genes in a cell-free system or transient expression of transfected genes. Methylation of C residues in some specific cis-regulatory regions can also block or enhance binding of transcriptional factors or repressors (Doerfler, supra; Christman, supra; Cedar, Cell 34:5503-5513 (1988); Tate et al., Curr. Opin. Genet. Dev. 3:225-231 [1993]; Christman et al., Virus Strategies, eds. Doerfler, W. & Bohm, P. (VCH, Weinheim, N.Y.) pp. 319-333 [1993]).

Disruption of normal patterns of DNA methylation has been linked to the development of cancer (Christman et al., Proc. Natl. Acad. Sci. USA 92:7347-7351 [1995]). The 5-MeC content of DNA from tumors and tumor derived cell lines is generally lower than normal tissues (Jones et al., Adv. Cancer Res 40:1-30 [1983]). Hypomethylation of specific oncogenes such as c-myc, c-Ki-ras and c-Ha-ras has been detected in a variety of human and animal tumors (Nambu et al., Jpn. J. Cancer (Gann) 78:696-704 [1987]; Feinberg et al., Biochem. Biophys. Res. Commun. 111:47-54 [1983]; Cheah et al., JNCI73:1057-1063 [1984]; Bhave et al., Carcinogenesis (Lond) 9:343-348 [1988]. In one of the best studied examples of human tumor progression, it has been shown that hypomethylation of DNA is an early event in development of colon cancer (Goetz et al., Science 228:187-290 [1985]). Interference with methylation in vivo can lead to tumor formation. Feeding of methylation inhibitors such as L-methionine or 5-azacytodine or severe deficiency of 5-adenosine methionine through feeding of a diet depleted of lipotropes has been reported to induce formation of liver tumors in rats (Wainfan et al., Cancer Res. 52:2071s-2077s [1992]). Studies show that extreme lipotrope deficient diets can cause loss of methyl groups at specific sites in genes such as c-myc, ras and c-fos (Dizik et al., Carcinogenesis 12:1307-1312 [1991]). Hypomethylation occurs despite the presence of elevated levels of DNA MTase activity (Wainfan et al., Cancer Res. 49:4094-4097 [1989]). Genes required for sustained active proliferation become inactive as methylated during differentiation and tissue specific genes become hypomethylated and are active. Hypomethylation can then shift the balance between the two states. In some embodiment, the present invention thus takes advantage of this naturally occurring phenomena, to provide compositions and methods for site specific methylation of specific gene promoters, thereby preventing transcription and hence translation of certain genes. In other embodiments, the present invention provides methods and compositions for upregulating the expression of a gene of interest (e.g., a tumor suppressor gene) by altering the gene's methylation patterns.

The present invention is not limited to the use of methylated oligonucleotides. Indeed, the use of non-methylated oligonucleotides for the inhibition of gene expression is specifically contemplated by the present invention. Experiments conducted during the course of development of the present invention (See e.g., Example 8) demonstrated that an unmethylated oligonucleotide targeted toward Bcl-2 inhibited the growth of lymphoma cells to a level that was comparable to that of a methylated oligonucleotide.

IV. Oligonucleotides

In some embodiments, the present invention provides antigene oligonucleotides for inhibiting the expression of oncogenes. Exemplary design and production strategies for antigenes are described below. The below description is not intended to limit the scope of antigene compounds suitable for use in the present invention. One skilled in the relevant recognizes that additional antigenes are within the scope of the present invention.

A. Oligonucleotide Design

In some embodiments, oligonucleotides are designed based on preferred design criteria. Such oligonucleotides can then be tested for efficacy using the methods disclosed herein. For example, in some embodiments, the oligonucleotides are methylated at least one, preferably at least two, and even more preferably, all of the CpG islands. In other embodiments, the oligonucleotides contain no methylation. The present invention is not limited to a particular mechanism. Indeed, an understanding of the mechanism is not necessary to practice the present invention. Nonetheless, it is contemplated that preferred oligonucleotides are those that have at least a 50% GC content and at least 2 GC dinucleotides. It is preferred that oligonucleotides do not self hybridize. In some embodiments, oligonucleotides are designed with at least 1 A or T to minimize self hybridization. In some embodiments, commercially available computer programs are used to survey oligonucleotides for the ability to self hybridize. Preferred oligonucleotides are at least 10, and preferably at least 15 nucleotides and no more than 100 nucleotides in length. Particularly preferred oligonucleotides are 18-24 nucleotides in length. In some embodiments, oligonucleotides comprise the universal protein binding sequences CGCCC and CGCG or the complements thereof.

It is also preferred that the oligonucleotide hybridize to a promoter region of a gene upstream from the TATA box of the promoter. It is also preferred that oligonucleotide compounds are not completely homologous to other regions of the human genome. The homology of the oligonucleotide compounds of the present invention to other regions of the genome can be determined using available search tools (e.g., BLAST, available at the Internet site of NCBI).

In some embodiments, oligonucleotides are designed to hybridize to regions of the promoter region of an oncogene known to be bound by proteins (e.g., transcription factors). Exemplary oligonucleotide compounds of the present invention are shown in FIGS. 2, 4, 6, 8, 10, and 12. The present invention is not limited to the oligonucleotides described herein. Other suitable oligonucleotides may be identified (e.g., using the criteria described above). Exemplary oligonucleotide variants of the disclosed oligonucleotides are shown in FIGS. 25-30. Candidate oligonucleotides may be tested for efficacy using any suitable method, including, but not limited to, those described in the illustrative examples below. Using the in vitro assay described in Examples 1 and 2 below, candidate oligonucleotides can be evaluated for their ability to prevent cell proliferation as a variety of concentrations. Particularly preferred oligonucleotides are those that inhibit gene expression of cell proliferation as a low concentration (e.g., less that 20 µM, and preferably, less than 10 µM in the in vitro assays disclosed herein).

B. Preferred Oligonucleotide Zones

In some embodiments, regions within the promoter region of an oncogene are further defined as preferred regions for hybridization of oligonucleotides. In some embodiments, these preferred regions are referred to as "hot zones."

In some preferred embodiments, hot zones are defined based on oligonucleotide compounds that are demonstrated to be effective (see above section on oligonucleotides) and those that are contemplated to be effective based on the preferred criteria for oligonucleotides described above. Preferred hot zones encompass 10 bp upstream and downstream of each compound included in each hot zone and have at least 1 CG or more within an increment of 40 bp further upstream or downstream of each compound. In preferred embodiments, hot zones encompass a maximum of 100 bp upstream and downstream of each oligonucleotide compound included in the hot zone. In additional embodiments, hot zones are defined at beginning regions of each promoter. These hot zones are defined either based on effective sequence(s) or contemplated sequences and have a preferred maximum length of 200 bp. Based on the above described criteria, exemplary hot zones were designed. These hot zones are shown in Table 1. Numbering is based on the sequences described in the Figures of the present invention.

TABLE 1

Exemplary Hot Zones

| Gene | Hot Zones |
|---|---|
| Bcl-2 | 1-40 |
| | 161-350 |
| | 401-590 |
| | 1002-1260 |
| c-erbB-2 | 205-344 |
| | 382-435 |
| c-K-ras | 1-289 |
| | 432-658 |
| c-Ha-ras | 21-220 |
| | 233-860 |
| | 1411-1530 |
| | 1631-1722 |
| c-myc | 3-124 |
| | 165-629 |
| TGF-α | 1-90 |
| | 175-219 |
| | 261-367 |
| | 431-930 |
| | 964-1237 |

C. Preparation and Formulation of Oligonucleotides

Any of the known methods of oligonucleotide synthesis can be used to prepare the modified oligonucleotides of the present invention. In some embodiments utilizing methylated oligonucleotides the nucleotide, dC is replaced by 5-methyl-dC where appropriate, as taught by the present invention. The modified or unmodified oligonucleotides of the present invention are most conveniently prepared by using any of the commercially available automated nucleic acid synthesizers. They can also be obtained from commercial sources that synthesize custom oligonucleotides pursuant to customer specifications.

While oligonucleotides are a preferred form of compound, the present invention comprehends other oligomeric oligonucleotide compounds, including but not limited to oligonucleotide mimetics such as are described below. The oligonucleotide compounds in accordance with this invention preferably comprise from about 18 to about 30 nucleobases (i.e., from about 18 to about 30 linked bases), although both longer and shorter sequences may find use with the present invention.

Specific examples of preferred compounds useful with the present invention include oligonucleotides containing modified backbones or non-natural internucleoside linkages. As defined in this specification, oligonucleotides having modified backbones include those that retain a phosphorus atom in the backbone and those that do not have a phosphorus atom in the backbone. For the purposes of this specification, modified oligonucleotides that do not have a phosphorus atom in their internucleoside backbone can also be considered to be oligonucleosides.

Preferred modified oligonucleotide backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'. Various salts, mixed salts and free acid forms are also included.

Preferred modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

In other preferred oligonucleotide mimetics, both the sugar and the internucleoside linkage (i.e., the backbone) of the nucleotide units are replaced with novel groups. The base units are maintained for hybridization with an appropriate nucleic acid target compound. One such oligomeric compound, an oligonucleotide mimetic that has been shown to have excellent hybridization properties, is referred to as a peptide nucleic acid (PNA). In PNA compounds, the sugar-backbone of an oligonucleotide is replaced with an amide containing backbone, in particular an aminoethylglycine backbone. The nucleobases are retained and are bound directly or indirectly to aza nitrogen atoms of the amide portion of the backbone. Representative United States patents that teach the preparation of PNA compounds include, but are not limited to, U.S. Pat. Nos.: 5,539,082; 5,714,331; and 5,719,262, each of which is herein incorporated by reference. Further teaching of PNA compounds can be found in Nielsen et al., Science 254:1497 (1991).

In some embodiments, oligonucleotides of the invention are oligonucleotides with phosphorothioate backbones and oligonucleosides with heteroatom backbones, and in particular —$CH_2$—, —NH—O—$CH_2$—, —$CH_2$—N($CH_3$)—O—$CH_2$— [known as a methylene (methylimino) or MMI backbone], —$CH_2$—O—N($CH_3$)—$CH_2$—, —$CH_2$—N($CH_3$)—N($CH_3$)—$CH_2$—, and —O—N($CH_3$)—$CH_2$—$CH_2$— [wherein the native phosphodiester backbone is represented as —O—P—O—$CH_2$—] of the above referenced U.S. Pat. No. 5,489,677, and the amide backbones of the above referenced U.S. Pat. No. 5,602,240. Also preferred are oligonucleotides having morpholino backbone structures of the above-referenced U.S. Pat. No. 5,034,506.

Modified oligonucleotides may also contain one or more substituted sugar moieties. Preferred oligonucleotides comprise one of the following at the 2' position: OH; F; O—, S—, or N-alkyl; O—, S—, or N-alkenyl; O—, S— or N-alkynyl; or O-alkyl-O-alkyl, wherein the alkyl, alkenyl and alkynyl may be substituted or unsubstituted $C_1$ to $C_{10}$ alkyl or $C_2$ to $C_{10}$ alkenyl and alkynyl. Particularly preferred are O[($CH_2$)$_n$O]$_m$$CH_3$, O($CH_2$)$_n$O$CH_3$, O($CH_2$)$_n$$NH_2$, O($CH_2$)$_n$$CH_3$, O($CH_2$)$_n$O$NH_2$, and O($CH_2$)$_n$ON[($CH_2$)$_n$$CH_3$)]$_2$, where n and m are from 1 to about 10. Other preferred oligonucleotides comprise one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. A preferred modification includes 2'-methoxyethoxy (2'-O—$CH_2CH_2OCH_3$, also known as 2'-O-(2-methoxyethyl) or 2'-MOE) (Martin et al., Helv. Chim. Acta 78:486 [1995]) i.e., an alkoxyalkoxy group. A further preferred modification includes 2'-dimethylaminooxyethoxy (i.e., a O($CH_2$)$_2$ON($CH_3$)$_2$ group), also known as 2'-DMAOE, and 2'-dimethylaminoethoxyethoxy (also known in the art as 2'-O-dimethylaminoethoxyethyl or 2'-DMAEOE), i.e., 2'-O—$CH_2$—O—$CH_2$—N($CH_3$)$_2$.

Other preferred modifications include 2'-methoxy(2'-O—$CH_3$), 2'-aminopropoxy(2'-O$CH_2$$CH_2$$CH_2$$NH_2$) and 2'-fluoro (2'-F). Similar modifications may also be made at other positions on the oligonucleotide, particularly the 3' position of the sugar on the 3' terminal nucleotide or in 2'-5' linked oligonucleotides and the 5' position of 5' terminal nucleotide. Oligonucleotides may also have sugar mimetics such as cyclobutyl moieties in place of the pentofuranosyl sugar.

Oligonucleotides may also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 8-azaguanine and 8-azaadenine, 7-deazaguanine and 7-deazaadenine and 3-deazaguanine and 3-deazaadenine. Further nucleobases include those disclosed in U.S. Pat. No. 3,687,808. Certain of these nucleobases are particularly useful for increasing the binding affinity of the oligomeric compounds of the invention. These include 5-substituted pyrimidines, 6-azapyrimidines and N-2, N-6 and O-6 substituted purines, including 2-aminopropyladenine, 5-propynyluracil and 5-propynylcytosine. 5-methylcytosine substitutions have been shown to increase nucleic acid duplex stability by 0.6-1.2° C. and are presently preferred base substitutions, even more particularly when combined with 2'-O-methoxyethyl sugar modifications.

Another modification of the oligonucleotides of the present invention involves chemically linking to the oligonucleotide one or more moieties or conjugates that enhance the activity, cellular distribution or cellular uptake of the oligonucleotide. Such moieties include but are not limited to lipid moieties such as a cholesterol moiety, cholic acid, a thioether, (e.g., hexyl-S-tritylthiol), a thiocholesterol, an aliphatic chain, (e.g., dodecandiol or undecyl residues), a phospholipid, (e.g., di-hexadecyl-rac-glycerol or triethylammonium 1,2-di-O-hexadecyl-rac-glycero-3-H-phosphonate), a polyamine or a polyethylene glycol chain or adamantane acetic acid, a palmityl moiety, or an octadecylamine or hexylamino-carbonyl-oxycholesterol moiety.

One skilled in the relevant art knows well how to generate oligonucleotides containing the above-described modifications. The present invention is not limited to the antisense oligonucleotides described above. Any suitable modification or substitution may be utilized.

It is not necessary for all positions in a given compound to be uniformly modified, and in fact more than one of the aforementioned modifications may be incorporated in a single compound or even at a single nucleoside within an oligonucleotide. The present invention also includes pharmaceutical compositions and formulations that include the antisense compounds of the present invention as described below.

D. Cocktails

In some embodiments, the present invention provides cocktails comprising two or more oligonucleotides directed towards promoter regions of genes (e.g., oncogenes). In some embodiments, the two oligonucleotides hybridize to different regions of the promoter of the same gene. In other embodiments, the two or more oligonucleotides hybridize to promoters of two different genes. The present invention is not limited to a particular mechanism. Indeed, an understanding of the mechanism is not necessary to practice the present invention. Nonetheless, it is contemplated that the combination of two or more compounds of the present invention provides an inhibition of cancer cell growth that is greater than the additive inhibition of each of the compounds administered separately.

V. Research Uses

The present invention is not limited to therapeutic applications. For example, in some embodiments, the present invention provides compositions and methods for the use of oligonucleotides as a research tool.

A. Kits

For example, in some embodiments, the present invention provides kits comprising oligonucleotides specific for inhibition of a gene of interest, and optionally cell lines (e.g., cancer cells lines) known to express the gene. Such kits find use, for example, in the identification of metabolic pathways or the involvement of genes in disease (e.g., cancer), as well as in diagnostic applications. In some embodiments, the kits further comprise buffer and other necessary reagents, as well as instructions for using the kits.

B. Target validation

In some embodiments, the present invention provides methods and compositions for use in the validation of gene targets (e.g., genes suspected of being involved in disease). For example, in some embodiments, the expression of genes identified in broad screening applications (e.g., gene expression arrays) as being involved in disease is downregulated using the methods and compositions of the present invention. The methods and compositions of the present invention are suitable for use in vitro and in vivo (e.g., in a non-human animal) for the purpose of target validation. In other embodiments, the compounds of the present invention find use in transplantation research (e.g., HLA inhibition).

C. Drug Screening

In other embodiments, the methods and compositions of the present invention are used in drug screening applications. For example, in some embodiments, oligonucleotides of the present invention are administered to a cell (e.g., in culture or in a non-human animal) in order to inhibit the expression of a gene of interest. In some embodiments, the inhibition of the gene of interest mimics a physiological or disease condition. In other embodiments, an oncogene is inhibited. Test compounds (e.g., small molecule drugs or oligonucleotide mimetics) are then administered to the test cell and the effect of the test compounds is assayed.

The test compounds of the present invention can be obtained using any of the numerous approaches in combinatorial library methods known in the art, including biological libraries; peptoid libraries (libraries of molecules having the functionalities of peptides, but with a novel, non-peptide backbone, which are resistant to enzymatic degradation but which nevertheless remain bioactive; see, e.g., Zuckennann et al., J. Med. Chem. 37: 2678-85 [1994]); spatially addressable parallel solid phase or solution phase libraries; synthetic library methods requiring deconvolution; the 'one-bead one-compound' library method; and synthetic library methods using affinity chromatography selection. The biological library and peptoid library approaches are preferred for use with peptide libraries, while the other four approaches are applicable to peptide, non-peptide oligomer or small molecule libraries of compounds (Lam (1997) Anticancer Drug Des. 12:145).

Examples of methods for the synthesis of molecular libraries can be found in the art, for example in: DeWitt et al., Proc. Natl. Acad. Sci. U.S.A. 90:6909 [1993]; Erb et al., Proc. Natl. Acad. Sci. USA 91:11422 [1994]; Zuckermann et al., J. Med. Chem. 37:2678 [1994]; Cho et al., Science 261:1303 [1993]; Carrell et al., Angew. Chem. Int. Ed. Engl. 33.2059 [1994]; Carell et al., Angew. Chem. Int. Ed. Engl. 33:2061 [1994]; and Gallop et al., J. Med. Chem. 37:1233 [1994].

Libraries of compounds may be presented in solution (e.g., Houghten, Biotechniques 13:412-421 [1992]), or on beads (Lam, Nature 354:82-84 [1991]), chips (Fodor, Nature 364: 555-556 [1993]), bacteria or spores (U.S. Pat. No. 5,223,409; herein incorporated by reference), plasmids (Cull et al., Proc. Nad. Acad. Sci. USA 89:18651869 [1992]) or on phage (Scott and Smith, Science 249:386-390 [1990]; Devlin Science 249: 404-406 [1990]; Cwirla et al., Proc. Natl. Acad. Sci. 87:6378-6382 [1990]; Felici, J. Mol. Biol. 222:301 [1991]).

VI. Compositions and Delivery

In some embodiments, the oligonucleotide compounds of the present invention are formulated as pharmaceutical compositions for delivery to a subject as a pharmaceutical. The novel antigen compounds of the present invention find use in the treatment of a variety of disease states and conditions in which it is desirable to inhibit the expression of a gene or the growth of a cell. In some preferred embodiments, the compounds are used to treat disease states resulting from uncontrolled cell growth, for example including, but not limited to, cancer. The present invention is not limited to the treatment of a particular cancer. The oligonucleotide compounds of the present invention are suitable for the treatment of a variety of cancers including, but not limited to, breast, colon, lung, stomach, pancreatic, bladder, leukemia, and lymphoma. The below discussion provides exemplary, non-limiting examples of formulations and dosages.

A. Pharmaceutical Compositions

The present invention further provides pharmaceutical compositions (e.g., comprising the oligonucleotide compounds described above). The pharmaceutical compositions of the present invention may be administered in a number of ways depending upon whether local or systemic treatment is desired and upon the area to be treated. Administration may be topical (including ophthalmic and to mucous membranes including vaginal and rectal delivery), pulmonary (e.g., by inhalation or insufflation of powders or aerosols, including by nebulizer; intratracheal, intranasal, epidermal and transdermal), oral or parenteral. Parenteral administration includes intravenous, intraarterial, subcutaneous, intraperitoneal or intramuscular injection or infusion; or intracranial, e.g., intrathecal or intraventricular, administration.

Pharmaceutical compositions and formulations for topical administration may include transdermal patches, ointments, lotions, creams, gels, drops, suppositories, sprays, liquids and powders. Conventional pharmaceutical carriers, aqueous, powder or oily bases, thickeners and the like may be necessary or desirable.

Compositions and formulations for oral administration include powders or granules, suspensions or solutions in water or non-aqueous media, capsules, sachets or tablets. Thickeners, flavoring agents, diluents, emulsifiers, dispersing aids or binders may be desirable.

Compositions and formulations for parenteral, intrathecal or intraventricular administration may include sterile aqueous solutions that may also contain buffers, diluents and other suitable additives such as, but not limited to, penetration enhancers, carrier compounds and other pharmaceutically acceptable carriers or excipients.

Pharmaceutical compositions of the present invention include, but are not limited to, solutions, emulsions, and liposome-containing formulations. These compositions may be generated from a variety of components that include, but are not limited to, preformed liquids, self-emulsifying solids and self-emulsifying semisolids.

The pharmaceutical formulations of the present invention, which may conveniently be presented in unit dosage form, may be prepared according to conventional techniques well known in the pharmaceutical industry. Such techniques include the step of bringing into association the active ingredients with the pharmaceutical carrier(s) or excipient(s). In general the formulations are prepared by uniformly and intimately bringing into association the active ingredients with liquid carriers or finely divided solid carriers or both, and then, if necessary, shaping the product.

The compositions of the present invention may be formulated into any of many possible dosage forms such as, but not limited to, tablets, capsules, liquid syrups, soft gels, suppositories, and enemas. The compositions of the present invention may also be formulated as suspensions in aqueous, non-aqueous or mixed media. Aqueous suspensions may further contain substances that increase the viscosity of the suspension including, for example, sodium carboxymethylcellulose, sorbitol and/or dextran. The suspension may also contain stabilizers.

In one embodiment of the present invention the pharmaceutical compositions may be formulated and used as foams. Pharmaceutical foams include formulations such as, but not limited to, emulsions, microemulsions, creams, jellies and liposomes. While basically similar in nature these formulations vary in the components and the consistency of the final product.

Agents that enhance uptake of oligonucleotides at the cellular level may also be added to the pharmaceutical and other compositions of the present invention. For example, cationic lipids, such as lipofectin (U.S. Pat. No. 5,705,188), cationic glycerol derivatives, and polycationic molecules, such as polylysine (WO 97/30731), also enhance the cellular uptake of oligonucleotides.

The compositions of the present invention may additionally contain other adjunct components conventionally found in pharmaceutical compositions. Thus, for example, the compositions may contain additional, compatible, pharmaceutically-active materials such as, for example, antipruritics, astringents, local anesthetics or anti-inflammatory agents, or may contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings and/or aromatic substances and the like which do not deleteriously interact with the nucleic acid(s) of the formulation.

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders may be desirable. Preferred oral formulations are those in which oligonucleotides of the invention are administered in conjunction with one or more penetration enhancers surfactants and chelators. Preferred surfactants include fatty acids and/or esters or salts thereof, bile acids and/or salts thereof. Preferred bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate, sodium glycodihydrofusidate. Preferred fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcamitine, an acylcholine, or a monoglyceride, a diglyceride or a pharmaceutically acceptable salt thereof (e.g. sodium). Also preferred are combinations of penetration enhancers, for example, fatty acids/salts in combination with bile acids/salts. A particularly preferred combination is the sodium salt of lauric acid, capric acid and UDCA. Further penetration enhancers include polyoxyethylene-9-lauryl ether, polyoxyethylene-20-cetyl ether. Oligonucleotides of the invention may be delivered orally in granular form including sprayed dried particles, or complexed to form micro or nanoparticles. Oligonucleotide complexing agents include poly-amino acids; polyimines; polyacrylates; polyalkylacrylates, polyoxethanes, polyalkylcyanoacrylates; cationized gelatins, albumins, starches, acrylates, polyethyleneglycols (PEG) and starches; polyalkylcyanoacrylates; DEAE-derivatized polyimines, pollulans, celluloses and starches. Particularly preferred complexing agents include chitosan, N-trimethylchitosan, poly-L-lysine, polyhistidine, polyornithine, polyspermines, protamine, polyvinylpyridine, polythiodiethylamino-methylethylene P(TDAE), polyaminostyrene (e.g. p-amino), poly(methylcyanoacrylate), poly(ethylcyanoacrylate), poly(butylcyanoacrylate), poly(isobutylcyanoacrylate), poly(isohexylcynaoacrylate), DEAE-methacrylate, DEAE-hexylacrylate, DEAE-acrylamide, DEAE-albumin and DEAE-dextran, polymethylacrylate, polyhexylacrylate, poly(D,L-lactic acid), poly(DL-lactic-co-glycolic acid (PLGA), alginate, and polyethyleneglycol (PEG).

Certain embodiments of the invention provide pharmaceutical compositions containing (a) one or more oligonucleotide compounds and (b) one or more other chemotherapeutic agents that function by a non-oligonucleotide mechanism. Examples of such chemotherapeutic agents include, but are not limited to, anticancer drugs such as daunorubicin, dactinomycin, doxorubicin, bleomycin, mitomycin, nitrogen mustard, chlorambucil, melphalan, cyclophosphamide, 6-mercaptopurine, 6-thioguanine, cytarabine (CA), 5-fluorouracil (5-FU), floxuridine (5-FUdR), methotrexate (MTX), colchicine, vincristine, vinblastine, etoposide, teniposide, cisplatin and diethylstilbestrol (DES). Anti-inflammatory drugs, including but not limited to nonsteroidal anti-inflammatory drugs and corticosteroids, and antiviral drugs, including but not limited to ribivirin, vidarabine, acyclovir and ganciclovir, may also be combined in compositions of the invention. Other non-oligonucleotide chemotherapeutic agents are also within the scope of this invention. Two or more combined compounds may be used together or sequentially.

B. Delivery

The oligonucleotide compounds of the present invention may be delivered using any suitable method. In some embodiments, naked DNA is administered. In other embodiments, lipofection is utilized for the delivery of nucleic acids to a subject. In still further embodiments, oligonucleotides are modified with phosphothiolates for delivery (See e.g., U.S. Pat. No. 6,169,177, herein incorporated by reference).

In some embodiments, nucleic acids for delivery are compacted to aid in their uptake (See e.g., U.S. Pat. Nos. 6,008, 366, 6,383,811 herein incorporated by reference). In some embodiment, compacted nucleic acids are targeted to a particular cell type (e.g., cancer cell) via a target cell binding moiety (See e.g., U.S. Pat. Nos. 5,844,107, 6,077,835, each of which is herein incorporated by reference).

In some embodiments, oligonucleotides are conjugated to other compounds to aid in their delivery. For example, in some embodiments, nucleic acids are conjugated to polyethylene glycol to aid in delivery (See e.g., U.S. Pat. Nos. 6,177, 274, 6,287,591, 6,447,752, 6,447,753, and 6,440,743, each of which is herein incorporated by reference). In yet other embodiments, oligonucleotides are conjugated to protected graft copolymers, which are chargeable" drug nano-carriers (PharmaIn). In still further embodiments, the transport of oligonucleotides into cells is facilitated by conjugation to vitamins (Endocyte, Inc, West Lafayette, Ind.; See e.g., U.S. Pat. Nos. 5,108,921, 5,416,016, 5,635,382, 6,291,673 and WO 02/085908; each of which is herein incorporated by reference). In other embodiments, oligonucleotides are conjugated to nanoparticles (e.g., NanoMed Pharmaceuticals; Kalamazoo, Mich.).

In other embodiments, oligonucleotides are enclosed in lipids (e.g., liposomes or micelles) to aid in delivery (See e.g., U.S. Pat. Nos. 6,458,382, 6,429,200; each of which is herein incorporated by reference). In still further embodiments, oligonucleotides are complexed with additional polymers to aid in delivery (See e.g., U.S. Pat. Nos. 6,379,966, 6,339,067, 5,744,335; each of which is herein incorporated by reference and Intradigm Corp., Rockville, Md.).

In still further embodiments, the controlled high pressure delivery system developed by Mirus (Madison, Wis.) is utilized for delivery of oligonucleotides.

C. Dosages

Dosing is dependent on severity and responsiveness of the disease state to be treated, with the course of treatment lasting from several days to several months, or until a cure is effected or a diminution of the disease state is achieved. Optimal dosing schedules can be calculated from measurements of drug accumulation in the body of the patient. The administering physician can easily determine optimum dosages, dosing methodologies and repetition rates. Optimum dosages may vary depending on the relative potency of individual oligonucleotides, and the delivery means, and can generally be estimated based on $EC_{50}$s found to be effective in in vitro and in vivo animal models or based on the examples described herein. In general, dosage is from 0.01 µg to 100 g per kg of body weight, and may be given once or more daily, weekly, monthly or yearly. In some embodiments, dosage is continuous (e.g., intravenously) for a period of from several hours to several days or weeks. In some embodiments, treatment is given continuously for a defined period followed by a treatment free period. In some embodiments, the pattern of continuous dosing followed by a treatment free period is repeated several times (e.g., until the disease state is diminished).

The treating physician can estimate repetition rates for dosing based on measured residence times and concentrations of the drug in bodily fluids or tissues. Following successful treatment, it may be desirable to have the subject undergo maintenance therapy to prevent the recurrence of the disease state, wherein the oligonucleotide is administered in maintenance doses, ranging from 0.01 µg to 100 g, preferably from 1 mg to 50 mg, and even more preferably from 6 mg to 30 mg per kg of body weight, once or more daily, to once every 20 years.

VII. Customized Patient Care

In some embodiments, the present invention provides customized patient care. The compositions of the present invention are targeted to specific genes unique to a patient's disease (e.g., cancer). For example, in some embodiments, a sample of the patient's cancer or other affected tissue (e.g., a biopsy) is first obtained. The biopsy is analyzed for the presence of expression of a particular gene (e.g., oncogene). In some preferred embodiments, the level of expression of an gene in a patient is analyzed. Expression may be detected by monitoring for the presence of RNA or DNA corresponding to a particular oncogene. Any suitable detection method may be utilized, including, but not limited to, those disclosed below.

Following the characterization of the gene expression pattern of a patient's gene of interest, a customized therapy is generated for each patient. In preferred embodiments, oligonucleotide compounds specific for genes that are aberrantly expressed in the patient (e.g., in a tumor) are combined in a treatment cocktail. In some embodiments, the treatment cocktail further includes additional chemotherapeutic agents (e.g., those described above). The cocktail is then administered to the patient as described above.

In some embodiments, the analysis of cancer samples and the selection of oligonucleotides for a treatment compound is automated. For example, in some embodiments, a software program that analyses the expression levels of a series of oncogenes to arrive at the optimum selection and concentration of oligonucleotides is utilized. In some embodiments, the analysis is performed by the clinical laboratory analyzing the patient sample and is transmitted to a second provider for formulation of the treatment cocktail. In some embodiments, the information is transmitted over the Internet, thus allowing for the shortest possible time in between diagnosis and the beginning of treatment.

A. Detection of RNA

In some embodiments, detection of oncogenes (e.g., including but not limited to, those disclosed herein) is detected by measuring the expression of corresponding MRNA in a tissue sample (e.g., cancer tissue). In other embodiments, expression of MRNA is measured in bodily fluids, including, but not limited to, blood, serum, mucus, and urine. In some preferred embodiments, the level of mRNA expression in measured quantitatively. RNA expression may be measured by any suitable method, including but not limited to, those disclosed below.

In some embodiments, RNA is detected by Northern blot analysis. Northern blot analysis involves the separation of RNA and hybridization of a complementary labeled probe. In other embodiments, RNA expression is detected by enzymatic cleavage of specific structures (INVADER assay, Third Wave Technologies; See e.g., U.S. Pat. Nos. 5,846,717, 6,090,543; 6,001,567; 5,985,557; and 5,994,069; each of which is herein incorporated by reference). The INVADER assay detects specific nucleic acid (e.g., RNA) sequences by using structure-specific enzymes to cleave a complex formed by the hybridization of overlapping oligonucleotide probes.

In still further embodiments, RNA (or corresponding cDNA) is detected by hybridization to a oligonucleotide probe). A variety of hybridization assays using a variety of technologies for hybridization and detection are available. For example, in some embodiments, TaqMan assay (PE Biosystems, Foster City, Calif.; See e.g., U.S. Pat. Nos. 5,962,233 and 5,538,848, each of which is herein incorporated by reference) is utilized. The assay is performed during a PCR reaction. The TaqMan assay exploits the 5'-3' exonuclease activity of the AMPLITAQ GOLD DNA polymerase. A probe consisting of an oligonucleotide with a 5'-reporter dye (e.g., a fluorescent dye) and a 3'-quencher dye is included in the PCR reaction. During PCR, if the probe is bound to its target, the 5'-3' nucleolytic activity of the AMPLITAQ GOLD polymerase cleaves the probe between the reporter and the quencher dye. The separation of the reporter dye from the quencher dye results in an increase of fluorescence. The signal accumulates with each cycle of PCR and can be monitored with a fluorimeter.

In yet other embodiments, reverse-transcriptase PCR (RT-PCR) is used to detect the expression of RNA. In RT-PCR, RNA is enzymatically converted to complementary DNA or "cDNA" using a reverse transcriptase enzyme. The cDNA is then used as a template for a PCR reaction. PCR products can be detected by any suitable method, including but not limited to, gel electrophoresis and staining with a DNA specific stain or hybridization to a labeled probe. In some embodiments, the quantitative reverse transcriptase PCR with standardized mixtures of competitive templates method described in U.S. Pat. Nos. 5,639,606, 5,643,765, and 5,876,978 (each of which is herein incorporated by reference) is utilized.

B. Detection of Protein

In other embodiments, gene expression of oncogenes is detected by measuring the expression of the corresponding protein or polypeptide. In some embodiments, protein expression is detected in a tissue sample. In other embodiments, protein expression is detected in bodily fluids. In some embodiments, the level of protein expression is quantitated. Protein expression may be detected by any suitable method. In some embodiments, proteins are detected by their binding to an antibody raised against the protein. The generation of antibodies is well known to those skilled in the art.

Antibody binding is detected by techniques known in the art (e.g., radioimmunoassay, ELISA (enzyme-linked immunosorbant assay), "sandwich" immunoassays, immunoradiometric assays, gel diffusion precipitation reactions, immunodiffusion assays, in situ immunoassays (e.g., using colloidal gold, enzyme or radioisotope labels, for example), Western blots, precipitation reactions, agglutination assays (e.g., gel agglutination assays, hemagglutination assays, etc.), complement fixation assays, immunofluorescence assays, protein A assays, and immunoelectrophoresis assays, etc.

In one embodiment, antibody binding is detected by detecting a label on the primary antibody. In another embodiment, the primary antibody is detected by detecting binding of a secondary antibody or reagent to the primary antibody. In a further embodiment, the secondary antibody is labeled. Many methods are known in the art for detecting binding in an immunoassay and are within the scope of the present invention.

In some embodiments, an automated detection assay is utilized. Methods for the automation of immunoassays include those described in U.S. Pat. nos. 5,885,530, 4,981,785, 6,159,750, and 5,358,691, each of which is herein incorporated by reference. In some embodiments, the analysis and presentation of results is also automated. For example, in some embodiments, software that generates an expression profile based on the presence or absence of a series of proteins corresponding to oncogenes is utilized.

In other embodiments, the immunoassay described in U.S. Pat. Nos. 5,599,677 and 5,672,480; each of which is herein incorporated by reference.

Experimental

The following examples are provided in order to demonstrate and further illustrate certain preferred embodiments and aspects of the present invention and are not to be construed as limiting the scope thereof.

In the experimental disclosure which follows, the following abbreviations apply: N (normal); M (molar); mM (millimolar); μM (micromolar); mol (moles); mmol (millimoles); μmol (micromoles); nmol (nanomoles); pmol (picomoles); g (grams); mg (milligrams); μg (micrograms); ng (nanograms); l or L (liters); ml (milliliters); μl (microliters); cm (centimeters); mm (millimeters); μm (micrometers); nm (nanometers); and ° C. (degrees Centigrade).

EXAMPLE 1

Materials and Methods

This Example describes experimental methods utilized in the below examples.

A. Cell Lines

Cell lines used in experiments of the present invention are described below.

MDA-MB-231

Tissue: adenocarcinoma; mammary gland; breast; pleural effusion

Tumorigenic: forms adenocarcinoma grade III

Receptors expressed: Epidermal Growth Factor (EGF) and Transforming growth factor (TGF-alpha)

Oncogene: wnt3+ and wnt7h+

REFERENCES

Siciliano M J, Barker P E, Cailleau R. Mutually exclusive genetic signatures of human breast tumor cell lines with a common chromosomal marker. Cancer Res. 1979 March; 39(3):919-22.

Calleau R, Olive M, Cruciger Q V. Long-term human breast carcinoma cell lines of metastatic origin: preliminary characterization. In vitro. 1978 November; 14(11):911-5.

Cruciger Q V, Pathak S, Calleau R. Human breast carcinomas: marker chromosomes involving 1 q in seven cases. Cytogenet Cell Genet. 1976; 17(4):231-5.

Satya-Prakash K L, Pathak S, Hsu T C, Olive M, Cailleau R. Cytogenetic analysis on eight human breast tumor cell lines: high frequencies of 1 q, 11 q and HeLa-like marker chromosomes. Cancer Genet Cytogenet 1981 January; 3(1):61-73

MCF7

Tissue: adenocarcinoma, mammary gland, breast

Metastatic site: pleural effusion

Receptors: estrogen receptor+

Oncogenes: wnt7h+

This cell line is also known to moderately express c-erbB-2 and overexpress c-myc oncogene Cellular product: Insulin like growth factor binding protein (IGFBP)

REFERENCES

Soule H D et al. A human cell line from a pleural effusion derived from a breast carcinoma. J. Natl. Cancer Inst. 51: 1409-1416, 1973

Landers J E et al. Translational enhancement of mdm2 oncogene expression in human tumor cells containing a stabilized wild-type p53 protein. Cancer Res. 57: 3562-3568, 1997

Bacus SS et al. Differentiation of cultured human cancer cells (AU-565 and MCF7) associated with loss of cell surface HER-2/neu oligonucleotide. Mol. Carcinog. 3: 350-362, 1990

MCF10CA1

MCF10 cells are derived from benign breast tissue from a woman with fibrocystic disease. MCF10 lines consists of several lines, one is MCF10A, an immortalized normal human breast cell line. MCF10A was transformed with T24

Ha-ras to make MCF10AneoT cells. MCF10AT with neoplastic progression potential was derived from xenograft passaged MCF10-AneoT. MCF10AT generates carcinoma in about 25% of xenografts. Fully malignant MCF10CA1 lines were derived from several xenograft passages of MCF10AT. MCF10CA1a forms tumors 100% of the time and it metastasizes. A kariotype of MCF10CA1a shows an extra copy of chromosome 1. It metastasizes into the lung 36 days after IV injection of the cells.

REFERENCES

Santner S J et al. Malignant MCF10CA1 cell lines derived from premalignant human breast epithelial MCF10AT cells. Breast Cancer Research and treatment 65: 101-110, 2001.

MYC-MT-1

A female MMTV-C-MYC transgenic mouse developed a mammary tumor. The tumor was isolated and a small fresh tissue is put into culture with a medium conditioned by Dr. Jushoa Liao at Karmanos Cancer Institute. This tumor cell line was established after 10 passages.

NMuMG
Tissue: Mouse normal mammary gland, epithelial
Strain: NAMRU, female
Tumorigenic: produce benign tumor in mice

REFERENCES

Owens R B. Glandular epithelial cells from mice: a method for selective cultivation. J. Natl. Cancer Inst. 52: 1375-1378, 1974

Owens R B et al. Epithelial cell cultures from normal glandular tissue of mice. J. Natl. Cancer Inst. 53: 261-269, 1974

Yingling J M et al. Mammalian dwarfins are phosphorylated in response to transforming growth factor beta and are implicated in control of cell growth. Proc. Natl. Acad. Sci. USA 93: 8940-8944, 1996

BxPC-3
Tissue: adenocarcinoma, pancreas
Cellular product: mucin, pancreatic cancer specific antigen; CEA, carcinoma embryonic antigen.
Source: 61 year old female
Tumorigenic: yes
Oncogenes: c-Ki-ras

REFERENCES

Tan M H et al. Characterization of a new primary human pancreatic tumor line. Cancer Invest. 4: 15-23, 1986

Loor R et al. Use of pancreas-specific antigen in immunodiagnosis of pancreatic cancer. Clin. Lab. Med. 2: 567-578, 1982

Lan M S et al. Polypeptide core of a human pancreatic tumor mucin antigen. Cancer Res. 50: 2997-3001, 1990

Chambers J A and Harris A. Expression of the cystic fibrosis gene and the major pancreatic mucin gene, MUCI, in human ductal epithelial cells. J. Cell Sci. 105: 417-422, 1993

T-47D
Tissue: ductal carcinoma, mammary gland, breast, duct
Metastatic site: pleural effusion
Source: pleural effusion of a 54 years old female with infiltrating ductal carcinoma of the breast
Receptor expression: estrogen, androgen, calcitonin, progesteron, glucocorticoid and prolactin positive.
Oncogenes: wnt3+ and wnt7h+This cell line is also know to overexpress c-erbB-2

REFERENCES

Keydar I et al., Establishment and characterization of a cell line of human breast carcinoma origin. Eur. J. Cancer 15: 659-670, 1979

Judge S M and Chatterton R T Jr. Progesterone-specific stimulation of triglyceride biosynthesis in a breast cancer cell line (T-47D). Cancer Res. 43: 4407-4412, 1983

Lamp S J et al. Calcitonin induction of a persistent activated state of adenylate cyclase in human breast cancer cells (T-47D). J. Biol. Chem. 256: 12269-12274, 1981

Sher E et al. Whole-cell uptake and nuclear localization of 1,25-dihydroxy-cholecalciferol by breast cancer cells (T-47D) in culture. Biochem. J. 200: 315-320, 1981

Freake H C et al. 1,25-Dihydroxyvitamin D3 specifically binds to a human breast cancer cell line (T-47D) and stimulates growth. Biochem. Biophys. Res. Commun. 101: 1131-1138, 1981

Faust J B and Meeker T C. Amplification and expression of the bcl-1 gene in human solid tumor cell lines. Cancer Res. 52: 2460-2463, 1992 RF33514:

Huguet E L et al. Differential expression of human Wnt genes 2, 3, 4, and 7B in human breast cell lines and normal and disease states of human breast tissue. Cancer Res. 54: 2615-2621, 1994

BT-474
Tissue: ductal carcinoma, mammary gland, breast
Source: 60 year old female
Oncogene: c-erbB-2

REFERENCES

Lasfargues E Y et al. Isolation of two human tumor epithelial cell lines from solid breast carcinomas. J. Natl. Cancer Inst. 61: 967-978, 1978

Lasfargues E Y et al. A human breast tumor cell line (BT-474) that supports mouse mammary tumor virus replication. In vitro 15: 723-729, 1979

Littlewood-Evans A J et al. The osteoclast-associated protease cathepsin K is expressed in human breast carcinoma. Cancer Res. 57: 5386-5390, 1997

WSU-FSCCL
Human B—cell line established in 1993
Source: from peripheral blood of a male patient with low grade follicular small cleaved cell lymphoma in leukemic phase.
Oncogenes: exhibiting chromosomal translocation for both c-myc and bcl-2

REFERENCE

Mohammad R M, Mohamed A N, Smith M R, Jawadi N S, AL-Khatib A. A unique EBV-Negative Low Grade Lymphoma Line (WSU-FSCCL) Exhibiting both t(14; 18) and t(8; 11). Cancer Genet Cytogenet 70:62-67, 1993

B. Cell Culture

Human breast cancer cells, MCF7, MCF1OCA1a, MDA-MB 231, MDA-MB 435.eB, and human normal breast cells, MCF10A were all obtained from Karmanos Cancer Institute. All cells were cultured in DMEM/F12 media (Gibco, Md.) supplemented with 10 mM HEPES, 29 mM sodium bicarbonate, penicillin (100 units/ml) and streptomycin (100 µg/ml). In addition, 10% calf serum, 10 µg/ml insulin (Sigma Chemical, St Louis, Mo.), and 0.5 nM estradiol was used in MCF7 media. 5% horse serum and insulin (10 µg/ml) was used for MCF 10Cala, and 10% fetal calf serum was used for MDA-MB 231 and 435 lines. MCF 1.0A culture was supplemented with 5% horse serum, insulin. (10 µg/ml), 100 ng/ml cholera enterotoxin (Calbiochem, Calif.), 0.5 µg/ml hydrocortisone (Sigma Chemical) and 20 ng/ml epidermal growth factor (Sigma Chemical). All flasks and plates were incubated in a humidified atmosphere of 95% air and 5% $CO_2$ at 37° C.

MYC-MT-1 cells were also cultured in DMEM/F12 media containing 10 ng/ml EGF (epithelial growth factor), 1 nM estradiol, 10 µg/ml insulin and 10% FBS (fetal bovine serum). BxPC-3 pancreatic carcinoma cell line and BT-474, breast tumor cell line were cultured in RPMI 1640 with 10% FBS. Breast tumor cell line, T-47D was cultured in the same media as BT-474 with the addition of 2.5 µg/ml insulin. NMuMG (normal mouse mammary gland cells) cell line was grown in DMEM media with 4.5 g/l glucose, 10 µg/ml insulin and 10% FBS.

All the above cells were seeded at 2500 to 5,000 cells/well in 96 well plates. The cells were treated with oligonucleotide compounds in fresh media (100 µl total volume) 24 hours after seeding. The media was replaced with fresh media without oligonucleotides 24 hours after treatment and every 48 hours for 6 to 7 days or until the control cells were 80 to 100% confluent. The inhibitory effect of oligonucleotide was evaluated using an MTT staining technique.

Human follicular lymphoma cell line, WSU-FSCCL was used to evaluate the effect of antic-myc oligonucleotides as well as anti-Bcl-2 oligonucleotides. FSCCL cells grow as a single cell suspension in tissue culture. The culture-e was maintained in RPMI 1640 supplemented with 10% fetal bovine serum, 1% L-glutamine, 100 units/ml penicillin and 1.00 µg/ml streptomycin. FSCCL cells were treated in 24 well plates ($2 \times 10^5$ cells/well/ml) with oligonucleotide compounds and incubated in a humidified atmosphere of 95% air and 5% $CO_2$ at 37° C. The cells were counted every 24 hours using a hemocytometer.

C. Oligonucleotide Preparation

All oligonucleotides were synthesized, gel purified anal lyophilized by BIOSYNTHESIS (Lewisville, Tex.) or Qiagen (Valencia, Calif.). Methylated oligonucleotides were methylated at all CpG sites. Methylated Oligonucleotides were dissolved in pure sterile water (Gibco, Invitrogen Corporation) and used to treat cells in culture.

D. Lipofectin Encapsulation

20 µg lipofectin (Invitrogen) and 16 µg oligonucleotides were each incubated with 200 µl Opti-MEM (Invitrogen) media in separate sterile tubes at room temperature for 45 min. They were then combined and incubated for an additional 15 min. 1.6 ml Opti-MEM media was then added to a final volume of 2 ml and a final concentration 1 µM oligonucleotide. The concentration of lipofectin and oligonucleotides can be adjusted based on their molecular weight and desired concentration of compounds. There was no cytotoxic effect at this level.

E. Cell Growth Inhibition Assay

Cell growth inhibition was assessed using 3-[4,5-Dimethyl-thiazol-2-yl]-2,5diphenyltetrazolium bromide (MTT) purchased from Sigma Chemical (St. Louis, Mo.). Cells were resuspended in culture media at 50,000 cells/ml and 100 µl was distributed into each well of a 96-well, flat bottomed plate (Costar Coming, N.Y., USA) and incubated for 24 hours. Media was changed to 100 µl fresh media containing the desired concentration of oligonucleotides and incubated for 24 hours. Controls had media with pure sterile water equal to the volume of oligonucleotide solution. The media was changed without further addition of oligonucleotides every 24 hours until the control cultures were confluent (6 to 7 days). Thereafter the media was removed and plates were washed two times with phosphate-buffered saline (PBS) and 100 µl of serum free media containing 0.5 mg/ml MTT dye was added into each well and incubated for 1 hour at 37° C. The media with dye was removed, washed with PBS and 100 µl of dimethyl sulfoxide (DMSO) was added to solubilize the reactive dye. The absorbance values were read using an automatic multiwell spectrophotometer (Bio-Tek Microplate Autoreader, Winooski, Vt., U.S.A.). Each treatment was repeated at least 3 times with 8 independent wells each time.

F. Protein Extraction and Western Blot Analysis

The cells were seeded and cultured in T25 tissue culture flasks (Costar, Corning, N.Y., U.S.A.) at 200,000 cells/flask. The cells were allowed to attach for 24 hours. The media was replaced with fresh media containing 10 to 20 µM oligonucleotides and incubated for 24 hours. The media was changed every 48 hours without further addition of inhibitors and cell cultures were continued until the control flasks were confluent (6-7 days). Cells were harvested using 1x trypsin:EDTA (Invitrogen, Gibco, Md.) and collected by centrifugation at 2000 rpm for 5 min. Cells were resuspended in 125 mM Tris-HCL buffer (pH 6.8), sonicated with 10-20% output and lysed in an equal volume of 8% SDS for a final concentration of 4% SDS. Cells extracts were boiled for 10 min, chilled on ice and centrifuged at 2,000 rpm for 5 min before collecting the supernatant. The protein was quantitated using BCA protein assay kit (Pierce, Rockford, Ill.). 50 to 100 µg of proteins were subjected to 10 to 15% gel (depending on molecular weight of each protein) electrophoresis and transferred to nitrocellulose membrane (Schleicher & Schuell, Kence, N.H.). Each membrane was blocked with 10% dry milk in TBSTe (Tris buffered saline, Tween 20) for 2 hr, prior to incubation with primary antibodies in TBST overnight. Antibodies to human c-myc, c-ha-ras and erbB-2 were mice IgG (Pharmingen San Diego, Calif.). Membranes were washed 3 times, 15 min each in TBST, then incubated with secondary antibodies conjugated with peroxidase for 1 hr. The membranes were washed 5 times, 10 min each in TBST and incubated with 2 ml each of Lumino/Enhancer and Stable peroxide solution (PIERCE) for 1 min. The membranes were exposed to X-ray film for 2 min (exposure time is adjusted from 10 seconds up to 24 hr if necessary).

EXAMPLE 2 c-ki-RAS

This example describes the ability of oligonucleotide compounds targeted against the promoter of the c-ki-Ras gene to inhibit the growth of cancer cell lines. Experiments were performed as described in Example 1. The results are shown in FIGS. 13 and 19. The sequences of the oligonucleotides targeted against c-ki-Ras as well as the sequence of c-ki-Ras gene are shown in FIGS. 5 and 6.

EXAMPLE 3

Bcl-2

This example describes the ability of oligonucleotide compounds targeted against the promoter of the bcl-2 gene to inhibit the growth of cancer cell lines. Experiments were performed as described in Example 1. The results are shown in FIGS. 14 and 20. The sequences of the oligonucleotides targeted against bcl-2 as well as the sequence of bcl-2 gene are shown in FIGS. 1 and 2.

EXAMPLE 4 c-ha-RAS

Figure 22:
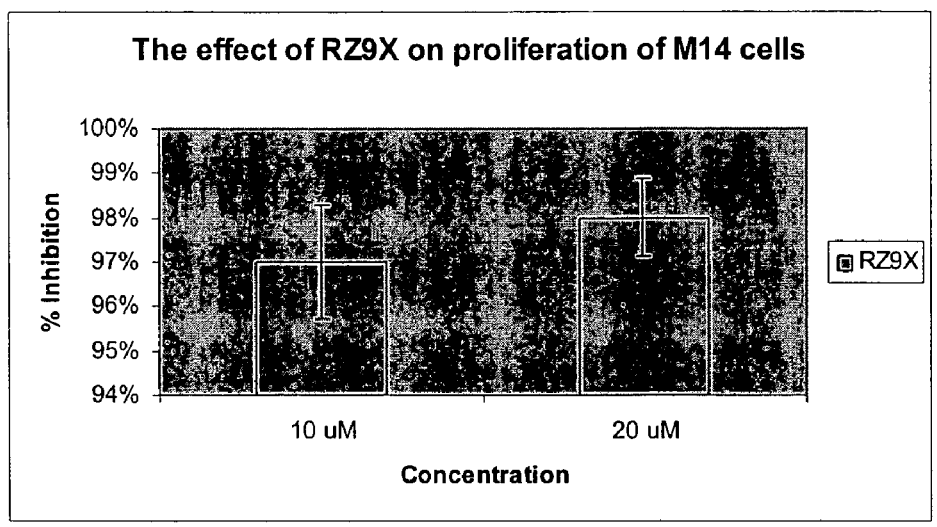
FIG. 22 shows the dose response curve of inhibition of expression of cell growth by antigenes to c-Ha-Ras used.

This example describes the ability of oligonucleotide compounds targeted against the promoter of the c-ha-Ras gene to inhibit the growth of cancer cell lines. Experiments were performed as described in Example 1. The results are shown in FIGS. 16 and 22. The sequences of the oligonucleotides targeted against c-ha-Ras as well as the sequence of c-ha-Ras gene are shown in FIGS. 7 and 8.

EXAMPLE 5 c-erbB-2

Figure 21:
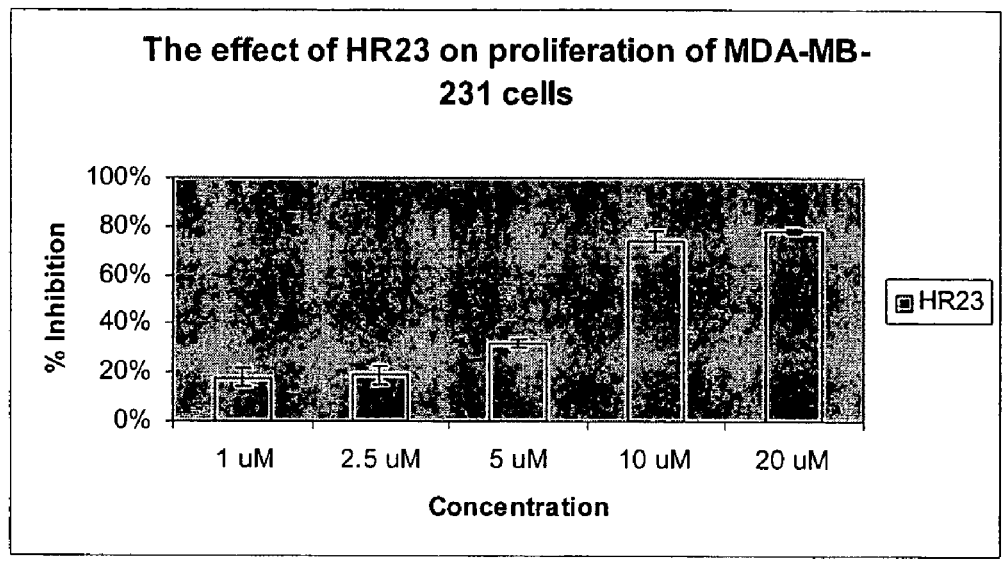
FIG. 21 shows the dose response curve of inhibition of expression of cell growth by antigenes to c-erb-2.

This example describes the ability of oligonucleotide compounds targeted against the promoter of the c-erbB-2 gene to inhibit the growth of cancer cell lines. Experiments were performed as described in Example 1. The results are shown in FIGS. 15 and 21. The sequences of the oligonucleotides targeted against c-erbB-2 as well as the sequence of c-erbB-2 gene are shown in FIGS. 3 and 4.

EXAMPLE 6 c-myc

Figure 23:
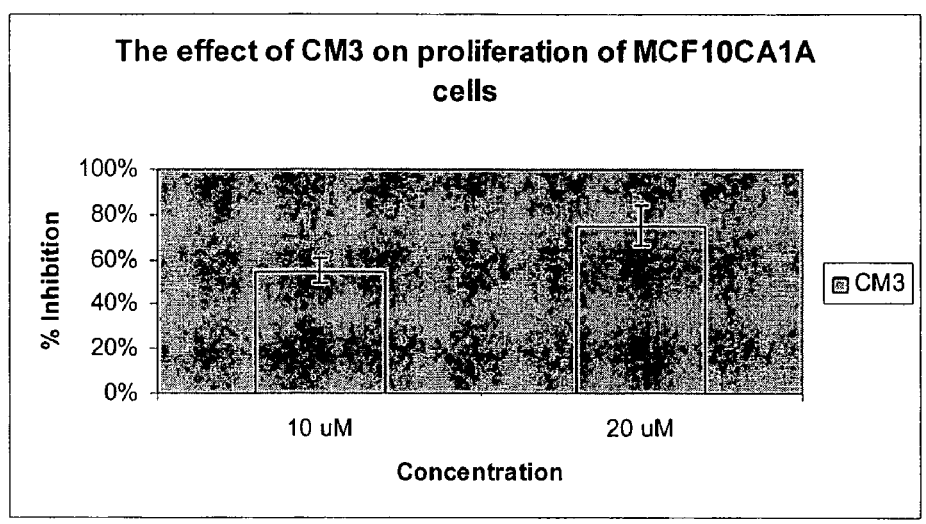
FIG. 23 shows the dose response curve of inhibition of expression of cell growth by antigenes to c-myc.

This example describes the ability of oligonucleotide compounds targeted against the promoter of the c-myc gene to inhibit the growth of cancer cell lines. Experiments were performed as described in Example 1. The results are shown in FIGS. 17 and 23. The sequences of the oligonucleotides targeted against c-myc as well as the sequence of c-myc gene are shown in FIGS. 9 and 10.

EXAMPLE 7

TGF-α

Figure 24:
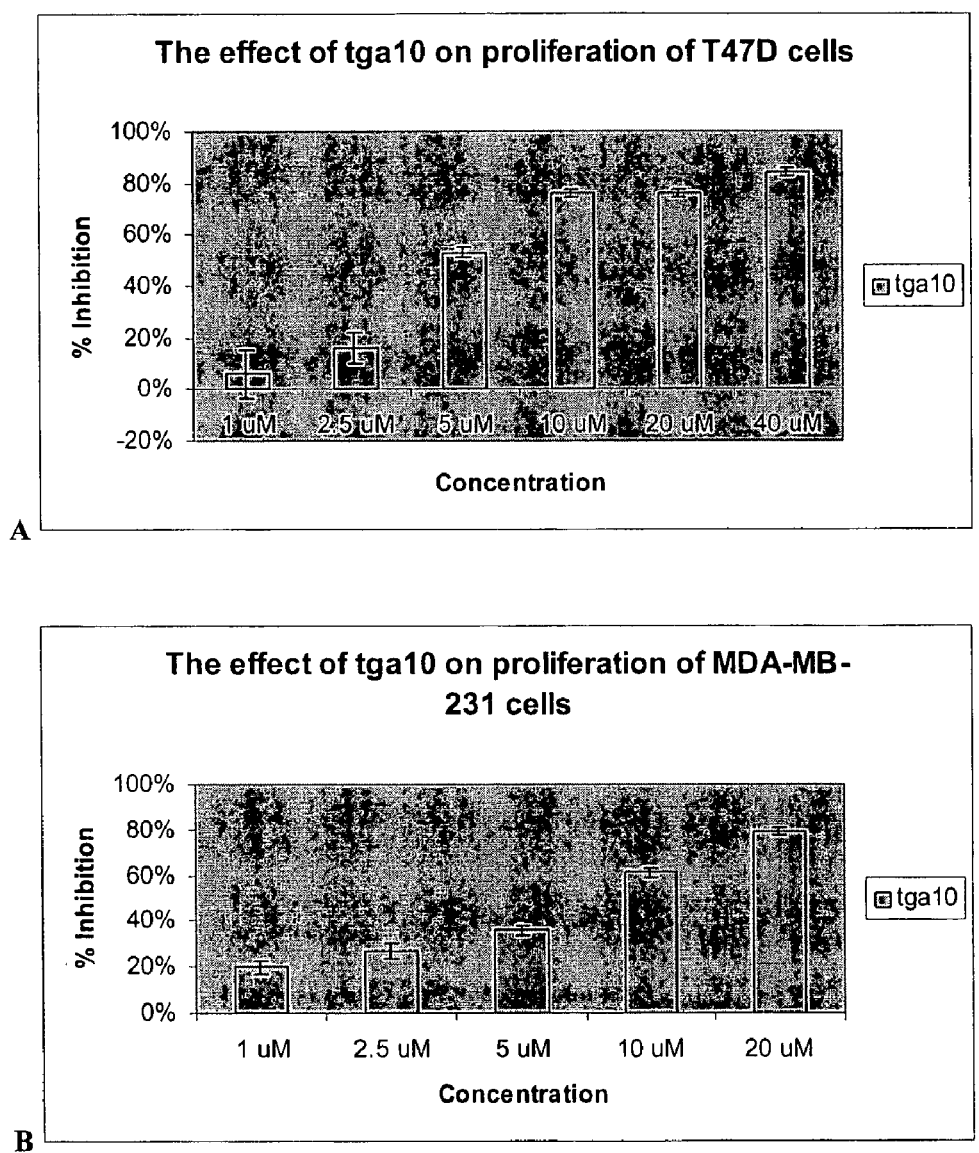
FIG. 24 shows the dose response curve of inhibition of expression of cell growth of T47D cells (A) and MDA-MB-231 cells (B) by antigenes to TGF-α.

This example describes the ability of oligonucleotide compounds targeted against the promoter of the TGF-α gene to inhibit the growth of cancer cell lines. Experiments were performed as described in Example 1. The results are shown in FIGS. 18 and 24. The sequences of the oligonucleotides targeted against TGF-α as well as the sequence of TGF-α gene are shown in FIGS. 11 and 12.

EXAMPLE 8

Inhibition of Cell Growth by Non-methylated Oligonucleotides

This example describes the inhibition of growth of lymphoma cell lines by non-methylated oligonucleotides targeted towards Bcl-2. WSU-FSCCL cells were plated in 24 well plates at $2 \times 10^5$ cells/well at t=−24hr. For each time point to be harvested, triplicate wells were treated at t=0 with the oligos at the concentrations indicated. Controls were plated in triplicate. Plates were incubated at 37° C. All cultures were monitored through out the experiment by cell count and viability every 24 hr for 4 days using trypan blue stain and hemacytometer.

The MABL2 oligonucleotide is targeted to the promoter region of Bcl-2 [5'-CAX GCA XGX GCA TCC CXG CCX GTG-3'] (SEQ ID NO:1438). Pho-Mabl-2 is an unmethylated version of MABL-2 [5'-CAC GCA CGC GCA TCC CCG CCC GTG -3'] (SEQ ID NO:1439). WSU-FSCCL—derived from human B cell lymphoma (low-grade follicular small-cleaved cell lymphoma). The experimental protocol is shown in Table 2.

TABLE 2

| Group | Target Gene | Compound | Cells | Conc. | Formulation | Viability Assay | Harvest for Methyl |
|---|---|---|---|---|---|---|---|
| 1 | Bcl-2 | MABL2 | FSCCL | 10 uM | none | n = 3 @ 24, 48 & 72 hr | n = 3 @ 72 hr |
| 2 | Bcl-2 | MABL2 | FSCCL | 3 uM | none | n = 3 @ 24, 48 & 72 hr | n = 3 @ 72 hr |
| 3 | Bcl-2 | PhoMABL2 | FSCCL | 10 uM | none | n = 3 @ 24, 48 & 72 hr | n = 3 @ 72 hr |
| 4 | none | none | FSCCL | n/a | none | n = 3 @ 24, 48 & 72 hr | n = 3 @ 72 hr |

Figure 25:
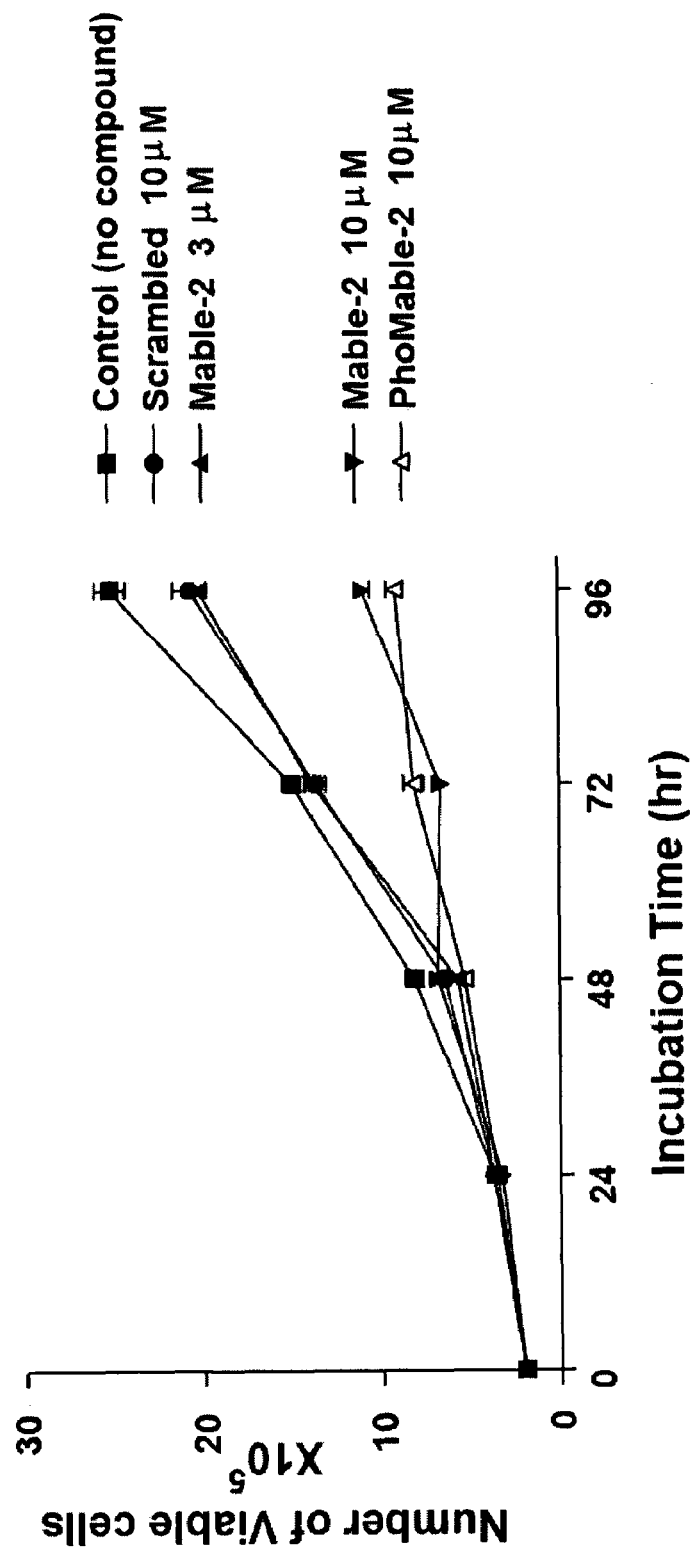
FIG. 25 shows inhibition of lymphoma cells by non-methylated oligonucleotides targeted toward Bcl-2.

The results are shown in FIG. 25. The results demonstrate that the unmethylated oligonucleotide directed against Bcl-1 is as effective as the methylated oligonucleotide in inhibiting cell growth.

All publications and patents mentioned in the above specification are herein incorporated by reference. Various modifications and variations of the described method and system of the invention will be apparent to those skilled in the art without departing from the scope and spirit of the invention. Although the invention has been described in connection with specific preferred embodiments, it should be understood that the invention as claimed should not be unduly limited to such specific embodiments. Indeed, various modifications of the described modes for carrying out the invention that are obvious to those skilled in the relevant fields are intended to be within the scope of the following claims.

SEQUENCE LISTING (1439 sequences)

SEQ ID NO: 1 - DNA, 1394 bp, Homo sapiens
ctcgagccctattaagtaagccgctgtgcttctagaagacctttttcttttcttggtgctttttgtcaaagactcttggagataaaaatacacacgtgcaacttgtttgtcctcttgtccttttttgctaggggctattcatgctgattaatttaaaactgtctgcttgcgcgtacacacgtctgcgagtgtgaatgtgtatgtgtgtatctatgtacctcatttgagaaagtgcggccaactaggattggctacgaggcaaaggtggagacctttaggagcccacccaccccagcgttaggacggtgggcctgaaagttactatatggaagtcctcatcgtgtagcactaaaccagtgtaaaaggtgttagggacagagggaaaacattgacttaaactgtcgtaaagcccttgataaacccctttccctggagctgctgagttctgcatggcctgggcacggactaggtgttcaggtggacacgggcggggatgcgcgtgcgtgtgtagtgcgcggacacctaggaagctacttgaaagtaaacaccacgctcggggcgtccctagacattgcttaaaacgtgcagagtcacctgtcttcacagcagggcagcgctgaggtctcactgctgggggcggtggggggcggcattggcctgggtcttccgcgcgccgagcgccggtaacacaacgtgtgtgtgtgtagcgcgtgtacacactctcatacacggctagaaagggtccaggcgacacacacactcccacatacacggccagaaaaggtccaggcgagacacacacacacacacacacacacacactccacacacactcacacggccagaaagggtccaggcggttggcggcgcttttccagcccttccgcccggcccggcgcgtcttttcatggcgcaccctcccgccagccgcccccctccgcactccgtcgtgcgattccccgggagcccccaccccgtcgcggaccccagcgaccaccaagtcgcaccggcctccgcaggcctgagcagaaggccccgcgcacacccacgcgcggggcccgcggggaggcctgtgccgcccgcgccacccactggccgggccccgcgggcgcagcggagcgggcgggtggccggcccggaggcgccctccccggcccggccccgcgcgccatgtgcccccggcgggacggccactcccgggcctgccgcggcgcctttaacccgggccagggagcggggcggagggggcggtcggggtggctcagaggagggctctttctttcttctttttttgaatgaaccgtgtgacgttacgcacaggaaaccggtcgggctgtgcagagaatgaagtaagaggacaggcaccacagccccgctcccgcccccttcctccc

SEQ ID NO: 2 - DNA, 23 bp, Artificial Sequence
  Synthetic
  modified_base (4)..(4): methylated C nucleotide
  modified_base (10)..(10): methylated C nucleotide
  modified_base (18)..(18): methylated C nucleotide
  modified_base (20)..(20): methylated C nucleotide
actcgcagacgtgtgtacgcgca

SEQ ID NO: 3 - DNA, 24 bp, Artificial Sequence
  Synthetic
  modified_base (3)..(3): methylated C nucleotide
  modified_base (7)..(7): methylated C nucleotide
  modified_base (9)..(9): methylated C nucleotide
  modified_base (17)..(17): methylated C nucleotide
  modified_base (21)..(21): methylated C nucleotide
cacgcacgcgcatccccgcccgtg

SEQ ID NO: 4 - DNA, 20 bp, Artificial Sequence
  Synthetic
  modified_base (3)..(3): methylated C nucleotide
  modified_base (6)..(6): methylated C nucleotide
  modified_base (10)..(10): methylated C nucleotide
  modified_base (13)..(13): methylated C nucleotide
  modified_base (15)..(15): methylated C nucleotide
  modified_base (17)..(17): methylated C nucleotide
accggcgctcggcgcgcgga

SEQ ID NO: 5 - DNA, 20 bp, Artificial Sequence
  Synthetic
  modified_base (3)..(3): methylated C nucleotide
  modified_base (5)..(5): methylated C nucleotide
  modified_base (8)..(8): methylated C nucleotide
  modified_base (13)..(13): methylated C nucleotide
  modified_base (17)..(17): methylated C nucleotide
gacgcgccgggccgggcgga

SEQ ID NO: 6 - DNA, 22 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (17)..(17): methylated C nucleotide
  modified_base (19)..(19): methylated C nucleotide
cccgcgcgtgggtgtgcgcggg

SEQ ID NO: 7 - DNA, 26 bp, Artificial Sequence
  Synthetic
  modified_base (3)..(3): methylated C nucleotide
  modified_base (7)..(7): methylated C nucleotide
  modified_base (12)..(12): methylated C nucleotide
  modified_base (17)..(17): methylated C nucleotide
  modified_base (21)..(21): methylated C nucleotide
  modified_base (23)..(23): methylated C nucleotide
cccgcccgctccgctgcgcccgcggg

SEQ ID NO: 8 - DNA, 21 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (13)..(13): methylated C nucleotide
  modified_base (18)..(18): methylated C nucleotide
ggcgcgcggggccgggccggg

SEQ ID NO: 9 - DNA, 27 bp, Artificial Sequence
  Synthetic
  modified_base (7)..(7): methylated C nucleotide
  modified_base (9)..(9): methylated C nucleotide
  modified_base (11)..(11): methylated C nucleotide
  modified_base (17)..(17): methylated C nucleotide
  modified_base (22)..(22): methylated C nucleotide
acatggcgcgcggggccgggccgggga

SEQ ID NO: 10 - DNA, 24 bp, Artificial Sequence
  Synthetic
gcggcttacttaatagggctcgag

SEQ ID NO: 11 - DNA, 28 bp, Artificial Sequence
  Synthetic
cctcgtagccaatcctagttggccgcac

SEQ ID NO: 12 - DNA, 24 bp, Artificial Sequence
  Synthetic
caggcccaccgtcctaacgctggg

SEQ ID NO: 13 - DNA, 25 bp, Artificial Sequence
  Synthetic
gtctagggacgccccgagcgtggtg

SEQ ID NO: 14 - DNA, 36 bp, Artificial Sequence
  Synthetic
cgccccccaccgcccccagcagtgagacctcagcgc

SEQ ID NO: 15 - DNA, 26 bp, Artificial Sequence
  Synthetic
ccgtgtatgagagtgtgtacacgcgc

SEQ ID NO: 16 - DNA, 32 bp, Artificial Sequence
  Synthetic
gcgccgccaaccgcctggaccctttctggccg

SEQ ID NO: 17 - DNA, 34 bp, Artificial Sequence
  Synthetic
cgcacgacggagtgcggaggggggcggctggcgg

SEQ ID NO: 18 - DNA, 23 bp, Artificial Sequence
  Synthetic
ccgcgacggggtgggggctcccg

SEQ ID NO: 19 - DNA, 23 bp, Artificial Sequence
  Synthetic
ccgcgacggggtgggggctcccg

SEQ ID NO: 20 - DNA, 42 bp, Artificial Sequence
  Synthetic
cggccagtgggtggcgcgggcggcacaggcctccccgcgggc

SEQ ID NO: 21 - DNA, 35 bp, Artificial Sequence
  Synthetic
gcgccgcggcaggcccgggagtggccgtcccgccg

SEQ ID NO: 22 - DNA, 36 bp, Artificial Sequence
  Synthetic
accccgaccgccccctccgccccgctccctggcccg

SEQ ID NO: 23 - DNA, 34 bp, Artificial Sequence
  Synthetic
gcccgaccggtttcctgtgcgtaacgtcacacgg

SEQ ID NO: 24 - DNA, 30 bp, Artificial Sequence
  Synthetic
ggacaagaggacaaacaagttgcacgtgtg

SEQ ID NO: 25 - DNA, 30 bp, Artificial Sequence
  Synthetic
ctggtttagtgctacacgatgaggacttcc

SEQ ID NO: 26 - DNA, 32 bp, Artificial Sequence
  Synthetic
cagggaaaggggtttatcaagggctttacgac

SEQ ID NO: 27 - DNA, 29 bp, Artificial Sequence
  Synthetic
cacctgaacacctagtccgtgcccaggcc

SEQ ID NO: 28 - DNA, 19 bp, Artificial Sequence
  Synthetic
gagggcgcctccgggccgg

SEQ ID NO: 29 - DNA, 539 bp, Homo sapiens
cccgggggtcctggaagccacaaggtaaacacaacacatccccctccttgactatcaattttactagaggatgtggtgggaaaaccattatttgatattaaaacaaataggcttgggatggagtaggatgcaagctcccaggaaagtttaagataaaacctgagacttaaaagggtgttaagagtggcagcctagggaatttatcccggactccgggggagggggcagagtcaccagcctctgcatttagggattctccgaggaaaagtgtgagaacggctgcaggcaacccagcttcccggcgctaggagggacgcacccaggcctgcgcgaagagagggagaaagtgaagctgggagttgccactcccagacttgttggaatgcagttggagggggcgagctgggagcgcgcttgctcccaatcacaggagaaggaggaggtggaggaggagggctgcttgaggaagtataagaatgaagttgtgaagctgagattcccctccattgggaccggagaaaccagggagcccccccggg

SEQ ID NO: 30 - DNA, 24 bp, Artificial Sequence
  Synthetic
  modified_base (4)..(4): methylated C nucleotide
  modified_base (6)..(6): methylated C nucleotide
  modified_base (17)..(17): methylated C nucleotide
aagcgcgctcccagctcgccccct

SEQ ID NO: 31 - DNA, 25 bp, Artificial Sequence
  Synthetic
  modified_base (7)..(7): methylated C nucleotide
  modified_base (19)..(19): methylated C nucleotide
  modified_base (22)..(22): methylated C nucleotide
tgggtgcgtccctcctagcgccggg

SEQ ID NO: 32 - DNA, 26 bp, Artificial Sequence
  Synthetic
  modified_base (3)..(3): methylated C nucleotide
  modified_base (6)..(6): methylated C nucleotide
  modified_base (20)..(20): methylated C nucleotide
ttcgccgcaggcctgggtgcgtccct

SEQ ID NO: 33 - DNA, 33 bp, Artificial Sequence
  Synthetic
  modified_base (1)..(1): methylated C nucleotide
  modified_base (3)..(3): methylated C nucleotide
  modified_base (17)..(17): methylated C nucleotide
  modified_base (29)..(29): methylated C nucleotide
  modified_base (32)..(32): methylated C nucleotide
cgcgcaggcctgggtgcgtccctcctagcgccg

SEQ ID NO: 34 - DNA, 25 bp, Artificial Sequence
  Synthetic
  modified_base (4)..(4): methylated C nucleotide
  modified_base (22)..(22): methylated C nucleotide
agccgttctcacacttttcctcgga

SEQ ID NO: 35 - DNA, 24 bp, Artificial Sequence
  Synthetic
  modified_base (13)..(13): methylated C nucleotide
  modified_base (20)..(20): methylated C nucleotide
tgccccctcccccggagtccggga

SEQ ID NO: 36 - DNA, 33 bp, Artificial Sequence
  Synthetic
  modified_base (13)..(13): methylated C nucleotide
  modified_base (15)..(15): methylated C nucleotide
  modified_base (26)..(26): methylated C nucleotide
attgggagcaagcgcgctcccagctcgccccct

SEQ ID NO: 37 - DNA, 35 bp, Artificial Sequence
  Synthetic
  modified_base (2)..(2): methylated C nucleotide
  modified_base (4)..(4): methylated C nucleotide
  modified_base (18)..(18): methylated C nucleotide
  modified_base (30)..(30): methylated C nucleotide
  modified_base (33)..(33): methylated C nucleotide
tcgcgcaggcctgggtgcgtccctcctagcgccgg

SEQ ID NO: 38 - DNA, 34 bp, Artificial Sequence
  Synthetic
  modified_base (2)..(2): methylated C nucleotide
  modified_base (4)..(4): methylated C nucleotide
  modified_base (17)..(17): methylated C nucleotide
  modified_base (29)..(29): methylated C nucleotide
  modified_base (32)..(32): methylated C nucleotide
tcgcgcaggcctgggtcgtccctcctagcgccgg

SEQ ID NO: 39 - DNA, 21 bp, Artificial Sequence
  Synthetic
gtggcttccaggacccccggg

SEQ ID NO: 40 - DNA, 24 bp, Artificial Sequence
  Synthetic
  modified_base (13)..(13): methylated C nucleotide
  modified_base (20)..(20): methylated C nucleotide
tgccccctcccccggagtccggga

SEQ ID NO: 41 - DNA, 33 bp, Artificial Sequence; identical to SEQ ID NO: 36
  Synthetic
  modified_base (13)..(13): methylated C nucleotide
  modified_base (15)..(15): methylated C nucleotide
  modified_base (26)..(26): methylated C nucleotide

SEQ ID NO: 42 - DNA, 35 bp, Artificial Sequence; identical to SEQ ID NO: 37
  Synthetic
  modified_base (2)..(2): methylated C nucleotide
  modified_base (4)..(4): methylated C nucleotide
  modified_base (18)..(18): methylated C nucleotide
  modified_base (30)..(30): methylated C nucleotide
  modified_base (33)..(33): methylated C nucleotide

SEQ ID NO: 43 - DNA, 34 bp, Artificial Sequence; identical to SEQ ID NO: 38
  Synthetic
  modified_base (2)..(2): methylated C nucleotide
  modified_base (4)..(4): methylated C nucleotide
  modified_base (17)..(17): methylated C nucleotide
  modified_base (29)..(29): methylated C nucleotide
  modified_base (32)..(32): methylated C nucleotide

SEQ ID NO: 44 - DNA, 19 bp, Artificial Sequence
  Synthetic
  modified_base (2)..(2): methylated C nucleotide
  modified_base (14)..(14): methylated C nucleotide
  modified_base (17)..(17): methylated C nucleotide
gcgtccctcctagcgccgg

SEQ ID NO: 45 - DNA, 29 bp, Artificial Sequence
  Synthetic
cccgggggggctccctggtttctccggtc

SEQ ID NO: 46 - DNA, 718 bp, Homo sapiens
cctgagggtggcggggtgctcttcgcagcttctctgtggagaccggtcagcggggcggcgtggccgctcgcggcgtctccctgtggcatccgcacagcccgccgcggtccggtcccgctccgggtcagaattggcggctgcggggacagccttgcggctaggcagggggcgggccgccgcgtgggtccggcagtccctcctcccgccaaggcgccgcccagacccgctctccagccggcccggctcgccaccctagaccgccccagccaccccttcctccgccggcccggcccccgctcctcccccgccggcccggcccggccccctccttctccccgccggcgctcgctgcctccccctcttccctcttcccacaccgccctcagccgctccctctcgtacgcccgtctgaagaagaatcgagcgcggaacgcatcgatagctctgccctctgcggccgcccggccccgaactcatcggtgtgctcggagctcgattttcctaggcggcggccgcggcggcggaggcagcagcggcggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggtacggagcggaccacccctcctgggcccctgcccggg

SEQ ID NO: 47 - DNA, 23 bp, Artificial Sequence
  Synthetic
  modified_base (3)..(3): methylated C nucleotide
  modified_base (8)..(8): methylated C nucleotide
  modified_base (14)..(14): methylated C nucleotide
  modified_base (19)..(19): methylated C nucleotide
  modified_base (21)..(21): methylated C nucleotide
cccggagcgggaccggaccgcgg

SEQ ID NO: 48 - DNA, 24 bp, Artificial Sequence
  Synthetic
  modified_base (3)..(3): methylated C nucleotide
  modified_base (11)..(11): methylated C nucleotide
  modified_base (13)..(13): methylated C nucleotide
  modified_base (16)..(16): methylated C nucleotide
  modified_base (21)..(21): methylated C nucleotide
gccggacccacgcggcggcccgcc

SEQ ID NO: 49 - DNA, 23 bp, Artificial Sequence
  Synthetic
  modified_base (5)..(5): methylated C nucleotide
  modified_base (8)..(8): methylated C nucleotide
  modified_base (11)..(11): methylated C nucleotide
  modified_base (13)..(13): methylated C nucleotide
  modified_base (17)..(17): methylated C nucleotide
  modified_base (20)..(20): methylated C nucleotide
cctccgccgccgcggccgccgcc

SEQ ID NO: 50 - DNA, 27 bp, Artificial Sequence
  Synthetic
  modified_base (3)..(3): methylated C nucleotide
  modified_base (6)..(6): methylated C nucleotide
  modified_base (9)..(9): methylated C nucleotide
  modified_base (18)..(18): methylated C nucleotide
  modified_base (21)..(21): methylated C nucleotide
  modified_base (24)..(24): methylated C nucleotide
ttcgccgccgccactgccgccgccgct

SEQ ID NO: 51 - DNA, 27 bp, Artificial Sequence
  Synthetic
  modified_base (2)..(2): methylated C nucleotide
  modified_base (7)..(7): methylated C nucleotide
  modified_base (10)..(10): methylated C nucleotide
  modified_base (19)..(19): methylated C nucleotide
  modified_base (22)..(22): methylated C nucleotide
  modified_base (25)..(25): methylated C nucleotide
ccgagccgccgccaccttcgccgccgc

SEQ ID NO: 52 - DNA, 25 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (11)..(11): methylated C nucleotide
  modified_base (22)..(22): methylated C nucleotide
tgcgcgcgctcgctcccagtccgaa

SEQ ID NO: 53 - DNA, 28 bp, Artificial Sequence
  Synthetic
gcggccacgccgccccgctgaccggtct

SEQ ID NO: 54 - DNA, 29 bp, Artificial Sequence
  Synthetic
ccacagagaagctgcgaagagcaccccgc

SEQ ID NO: 55 - DNA, 34 bp, Artificial Sequence
  Synthetic
gcgggctgtgcggatgccacagggagacgccgcg

SEQ ID NO: 56 - DNA, 26 bp, Artificial Sequence
  Synthetic
gccgcaaggctgtccccgcagccgcc

SEQ ID NO: 57 - DNA, 25 bp, Artificial Sequence
  Synthetic
gcgggtctgggcggcgccttggcgg

SEQ ID NO: 58 - DNA, 27 bp, Artificial Sequence
  Synthetic
cggtctagggtggcgagccgggccggc

SEQ ID NO: 59 - DNA, 33 bp, Artificial Sequence
  Synthetic
gccggcgggggaggagcgggggccgggccggcg

SEQ ID NO: 60 - DNA, 37 bp, Artificial Sequence
  Synthetic
gcgagcgccggcggggagaaggagggggccgggccgg

SEQ ID NO: 61 - DNA, 23 bp, Artificial Sequence
  Synthetic
gctatcgatgcgttccgcgctcg

SEQ ID NO: 62 - DNA, 42 bp, Artificial Sequence
  Synthetic
cgagctccgagcacaccgatgagttcggggccgggcggccgc

SEQ ID NO: 63 - DNA, 33 bp, Artificial Sequence
  Synthetic
gacgggcgtacgagagggagcggctgagggcgg

SEQ ID NO: 64 - DNA, 31 bp, Artificial Sequence
  Synthetic
ccgctgagcctctggccccgccgccgccttc

SEQ ID NO: 65 - DNA, 21 bp, Artificial Sequence
  Synthetic
cgctccgtacctctctcccgc

SEQ ID NO: 66 - DNA, 1740 bp, Homo sapiens
ggatcccagcctttccccagcccgtagccccgggacctccgcggtgggcggcgccgcgctgccggcgcagggagggcctctggtgcaccggcaccgctgagtcgggttctctcgccggcctgttcccgggagagcccggggccctgctcggagatgccgccccgggcccccagacaccggctccctggccttcctcgagcaaccccgagctcggctccggtctccagccaagcccaaccccgagaggccgcggccctactggctccgcctcccgcgttgctcccggaagccccgcccgaccgcggctcctgacagacgggccgctcagccaaccggggtggggcggggcccgatggcgcgcagccaatggtaggccgcgcctggcagacggacgggcgcggggcggggcgtgcgcaggcccgcccgagtctccgccgcccgtgccctgcgcccgcaacccgagccgcacccgccgcggacggagcccatgcgcggggcgaaccgcgcgcccccgcccccgccccgccccggcctcggccccggccctggccccgggggcagtcgcgcctgtgaacggtgagtgcgggcagggatcggccgggccgcgcgccctcctcgcccccaggcggcagcaatacgcgcggcgcgggccgggggcgcggggccggcgggcgtaagcggcggcggcggcggcgggtgggtggggccgggcggggcccgcgggcacaggtgagcgggcgtcgggggctgcggcgggcgggggccccttcctccctggggcctgcgggaatccgggccccacccgtggcctcgcgctgggcacggtccccacgccggcgtacccgggagcctcgggcccggcgccctcacacccgggggcgtctgggaggaggcggccgcggccacggcacgcccgggcacccccgattcagcatcacaggtcgcggaccaggccgggggcctcagccccagtgccttttccctctccgggtctcccgcgccgcttctcggccccttcctgtcgctcagtccctgcttcccaggagctcctctgtcttctccagctttctgtggctgaaagatgcccccggttccccgccgggggtgcggggcgctgcccgggtctgccctcccctcggcggcgcctagtacgcagtaggcgctcagcaaatacttgtcggaggcaccagcgccgcggggcctgcaggctggcactagcctgcccgggcacgccgtggcgcgctccgccgtggccagacctgttctggaggacggtaacctcagccctcgggcgcctccctttagcctttctgccgacccagcagcttctaatttgggtgcgtggttgagagcgctcagctgtcagccctgcctttgagggctgggtcccttttcccatcactgggtcattaagagcaagtgggggcgaggcgacagccctcccgcacgctgggttgcagctgcacaggtaggcacgctgcagtccttgctgcctggcgttggggcccagggaccgctgtgggtttgcccttcagatggccctgccagcagctgccctgtggggcctggggctgggcctgggcctggctgagcagggccctccttggcaggtggggcaggagaccctgtaggaggaccccgggccgcaggcccctgaggagcgatgacggaatataagctggtggtggtgggcgccggcggtgtgggcaagagtgcgctgaccatccagctgatccagaa

SEQ ID NO: 67 - DNA, 26 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (12)..(12): methylated C nucleotide
  modified_base (17)..(17): methylated C nucleotide
  modified_base (19)..(19): methylated C nucleotide
ggcgcgcggttcgccccgcgcatggg

SEQ ID NO: 68 - DNA, 26 bp, Artificial Sequence
  Synthetic
ggcgcgcggttcgccccgcgcatggg

SEQ ID NO: 69 - DNA, 32 bp, Artificial Sequence
  Synthetic
  modified_base (4)..(4): methylated C nucleotide
  modified_base (10)..(10): methylated C nucleotide
  modified_base (27)..(27): methylated C nucleotide
ttccgtcatcgctcctcaggggcctgcggccc

SEQ ID NO: 70 - DNA, 28 bp, Artificial Sequence
  Synthetic
  modified_base (2)..(2): methylated C nucleotide
  modified_base (6)..(6): methylated C nucleotide
  modified_base (11)..(11): methylated C nucleotide
  modified_base (16)..(16): methylated C nucleotide
  modified_base (18)..(18): methylated C nucleotide
  modified_base (22)..(22): methylated C nucleotide
  modified_base (26)..(26): methylated C nucleotide
gcgcacgccccgccccgcgcccgtccgt

SEQ ID NO: 71 - DNA, 27 bp, Artificial Sequence
  Synthetic
  modified_base (3)..(3): methylated C nucleotide
  modified_base (8)..(8): methylated C nucleotide
  modified_base (14)..(14): methylated C nucleotide
  modified_base (20)..(20): methylated C nucleotide
  modified_base (22)..(22): methylated C nucleotide
  modified_base (24)..(24): methylated C nucleotide
ggcggggcgggggcgggggcgcgcggt

SEQ ID NO: 72 - DNA, 30 bp, Artificial Sequence
  Synthetic
  modified_base (7)..(7): methylated C nucleotide
  modified_base (11)..(11): methylated C nucleotide
  modified_base (27)..(27): methylated C nucleotide
gggaggcgcccgagggctgaggttaccgtc

SEQ ID NO: 73 - DNA, 40 bp, Artificial Sequence
  Synthetic
  modified_base (13)..(13): methylated C nucleotide
  modified_base (15)..(15): methylated C nucleotide
  modified_base (17)..(17): methylated C nucleotide
  modified_base (22)..(22): methylated C nucleotide
  modified_base (27)..(27): methylated C nucleotide
  modified_base (29)..(29): methylated C nucleotide
cgggggcgggggcgcgcggttcgccccgcgcatgggctcc

SEQ ID NO: 74 - DNA, 20 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (12)..(12): methylated C nucleotide
  modified_base (17)..(17): methylated C nucleotide
  modified_base (19)..(19): methylated C nucleotide
ggcgcgcggttcgccccgcg

SEQ ID NO: 75 - DNA, 29 bp, Artificial Sequence
  Synthetic
  modified_base (2)..(2): methylated C nucleotide
  modified_base (4)..(4): methylated C nucleotide
  modified_base (10)..(10): methylated C nucleotide
  modified_base (17)..(17): methylated C nucleotide
  modified_base (27)..(27): methylated C nucleotide
gcgcgccatcgggccccgccccaccccgg

SEQ ID NO: 76 - DNA, 32 bp, Artificial Sequence
  Synthetic
  modified_base (2)..(2): methylated C nucleotide
  modified_base (5)..(5): methylated C nucleotide
  modified_base (8)..(8): methylated C nucleotide
  modified_base (11)..(11): methylated C nucleotide
  modified_base (14)..(14): methylated C nucleotide
  modified_base (17)..(17): methylated C nucleotide
  modified_base (23)..(23): methylated C nucleotide
  modified_base (27)..(27): methylated C nucleotide
  modified_base (30)..(30): methylated C nucleotide
ccgccgccgccgccgccgcttacgcccgccgg

SEQ ID NO: 77 - DNA, 28 bp, Artificial Sequence
  Synthetic
  modified_base (2)..(2): methylated C nucleotide
  modified_base (5)..(5): methylated C nucleotide
  modified_base (10)..(10): methylated C nucleotide
  modified_base (12)..(12): methylated C nucleotide
  modified_base (17)..(17): methylated C nucleotide
  modified_base (20)..(20): methylated C nucleotide
  modified_base (26)..(26): methylated C nucleotide
acggcggagcgcgccacggcgtgcccgg

SEQ ID NO: 78 - DNA, 31 bp, Artificial Sequence
  Synthetic
  modified_base (3)..(3): methylated C nucleotide
  modified_base (7)..(7): methylated C nucleotide
  modified_base (19)..(19): methylated C nucleotide
agcgtgcgggagggctgtcgcctcgccccca

SEQ ID NO: 79 - DNA, 32 bp, Artificial Sequence
  Synthetic
  modified_base (2)..(2): methylated C nucleotide
  modified_base (8)..(8): methylated C nucleotide
  modified_base (25)..(25): methylated C nucleotide
  modified_base (30)..(30): methylated C nucleotide
ccgtcatcgctcctcaggggcctgcggcccgg

SEQ ID NO: 80 - DNA, 28 bp, Artificial Sequence
  Synthetic
  modified_base (2)..(2): methylated C nucleotide
  modified_base (6)..(6): methylated C nucleotide
  modified_base (9)..(9): methylated C nucleotide
  modified_base (18)..(18): methylated C nucleotide
  modified_base (21)..(21): methylated C nucleotide
  modified_base (25)..(25): methylated C nucleotide
ccgcccgccgcagcccccgacgcccgct

SEQ ID NO: 81 - DNA, 29 bp, Artificial Sequence
  Synthetic
  modified_base (2)..(2): methylated C nucleotide
  modified_base (4)..(4): methylated C nucleotide
  modified_base (10)..(10): methylated C nucleotide
  modified_base (17)..(17): methylated C nucleotide
  modified_base (27)..(27): methylated C nucleotide
gcgcgccatcgggccccgccccaccccgg

SEQ ID NO: 82 - DNA, 55 bp, Artificial Sequence
  Synthetic
  modified_base (4)..(4): methylated C nucleotide
  modified_base (10)..(10): methylated C nucleotide
  modified_base (15)..(15): methylated C nucleotide
  modified_base (20)..(20): methylated C nucleotide
  modified_base (26)..(26): methylated C nucleotide
  modified_base (32)..(32): methylated C nucleotide
  modified_base (34)..(34): methylated C nucleotide
  modified_base (36)..(36): methylated C nucleotide
  modified_base (41)..(41): methylated C nucleotide
  modified_base (46)..(46): methylated C nucleotide
  modified_base (48)..(48): methylated C nucleotide
ggccgaggccggggcggggcgggggcgggggcgcgcggttcgccccgcgcatggg

SEQ ID NO: 83 - DNA, 33 bp, Artificial Sequence
  Synthetic
  modified_base (2)..(2): methylated C nucleotide
  modified_base (7)..(7): methylated C nucleotide
  modified_base (9)..(9): methylated C nucleotide
  modified_base (20)..(20): methylated C nucleotide
  modified_base (24)..(24): methylated C nucleotide
  modified_base (26)..(26): methylated C nucleotide
  modified_base (29)..(29): methylated C nucleotide
tcgccccgcgcatgggctccgtccgcggcgggt

SEQ ID NO: 84 - DNA, 26 bp, Artificial Sequence
  Synthetic
  modified_base (2)..(2): methylated C nucleotide
  modified_base (7)..(7): methylated C nucleotide
  modified_base (14)..(14): methylated C nucleotide
  modified_base (18)..(18): methylated C nucleotide
gcggctcgggttgcgggcgcagggca

SEQ ID NO: 85 - DNA, 38 bp, Artificial Sequence
  Synthetic
gcgccggcagcgcggcgccgcccaccgcggaggtcccg

SEQ ID NO: 86 - DNA, 33 bp, Artificial Sequence
  Synthetic
cggcgagagaacccgactcagcggtgccggtgc

SEQ ID NO: 87 - DNA, 34 bp, Artificial Sequence
  Synthetic
gcggcatctccgagcagggccccgggctctcccg

SEQ ID NO: 88 - DNA, 25 bp, Artificial Sequence
  Synthetic
ccggagccgagctcggggttgctcg

SEQ ID NO: 89 - DNA, 28 bp, Artificial Sequence
  Synthetic
gcggagccagtagggccgcggcctctcg

SEQ ID NO: 90 - DNA, 22 bp, Artificial Sequence
  Synthetic
cggggcttccgggagcaacgcg

SEQ ID NO: 91 - DNA, 27 bp, Artificial Sequence
  Synthetic
cggcccgtctgtcaggagccgcggtcg

SEQ ID NO: 92 - DNA, 24 bp, Artificial Sequence
  Synthetic
cgggcggcggagactcgggcgggc

SEQ ID NO: 93 - DNA, 38 bp, Artificial Sequence
  Synthetic
ccgttcacaggcgcgactgcccccggggccagggccgg

SEQ ID NO: 94 - DNA, 24 bp, Artificial Sequence
  Synthetic
cgaggagggcgcgcggcccggccg

SEQ ID NO: 95 - DNA, 35 bp, Artificial Sequence
  Synthetic
cgcgaggccacgggtggggcccggattcccgcagg

SEQ ID NO: 96 - DNA, 26 bp, Artificial Sequence
  Synthetic
cgggtacgccggcgtggggaccgtgc

SEQ ID NO: 97 - DNA, 31 bp, Artificial Sequence
  Synthetic
cgcccccgggtgtgagggcgccgggcccgag

SEQ ID NO: 98 - DNA, 25 bp, Artificial Sequence
  Synthetic
cgggcgtgccgtggccgcggccgcc

SEQ ID NO: 99 - DNA, 30 bp, Artificial Sequence
  Synthetic
cgagaagcggcgcgggagacccggagaggg

SEQ ID NO: 100 - DNA, 28 bp, Artificial Sequence
  Synthetic
gcgccccgcacccccggcggggaaccgg

SEQ ID NO: 101 - DNA, 35 bp, Artificial Sequence
  Synthetic
gcgtactaggcgccgccgaggggagggcagacccg

SEQ ID NO: 102 - DNA, 38 bp, Artificial Sequence
  Synthetic
cgcggcgctggtgcctccgacaagtatttgctgagcgc

SEQ ID NO: 103 - DNA, 25 bp, Artificial Sequence
  Synthetic
gggagccggtgtctgggggcccggg

SEQ ID NO: 104 - DNA, 25 bp, Artificial Sequence
  Synthetic
ctgccaggcgcggcctaccattggc

SEQ ID NO: 105 - DNA, 24 bp, Artificial Sequence
  Synthetic
ctgtgcccgcgggccccgcccggc

SEQ ID NO: 106 - DNA, 39 bp, Artificial Sequence
  Synthetic
cggcctggtccgcgacctgtgatgctgaatcgggggtgc

SEQ ID NO: 107 - DNA, 30 bp, Artificial Sequence
  Synthetic
cagcgcactcttgcccacaccgccggcgcc

SEQ ID NO: 108 - DNA, 1140 bp, Homo sapiens
  misc_feature (825)..(825): n is a, c, g, or t
ctgcagcctggtacgcgcgtggctggcggtgggcgcgcagtggttctcggtgtggagggcagctgttccccctgcgatgatttatactcacaggacaaggatgcgatttgtcaaacactacgaggagtagcagagaaagggagagggtttgaaagggagcaaaagaaaatggtaggcgcgcgtagttaattcatgcggctctcttactctgtttacatcctagaggtagagtgctcggctgcccggctgagtctcctccccaccttccccaccctccccaccctccccataagcgccctcccgggttcccaaagcagagggcgtgggggaaaagaaaaaagatcctctctcgctaatctccgcccaccggccctttataatgcgagggtctggacggctgaggacccccgagctgtgctgctcgcggccgccaccgcgggccccggccgtctttggctcccctcctgcctcgagaagggcagggcttctcagaggcttggcgggaaaaagaacggagggagggatcgctctgagtataaaagccgattttcggggctttatctaactcgctgtagtaattttaccgagaggcagagggagcgagcgggcggccgcctagggtggaagagccgggcgagtagagttgcacttgggaagggagatccggagcgaatcgggggcttcgcctctggcccagccctcccgctgatcccccaggcagtggtccgcaatccttgccgcattcacgaaaatttggccataacacggggcggtcactttacactggaacgtccaacacccgagcaaggacgcgagtctcccgancgcgaggagactattgagatgtgtcgattggctacatagggtgtcttttctcccactcctgcgccatcgacagttttctcagaatacctttggtaagtggggctggggtgggcgttatttcagaactgtatcgggcaaattgtattcctcaccgccacctcccgcggcttcttaagggcgccagggccgctttcgattcctctgccgctgcggggccgacgttcgggactgagcactgcgcgctgcgccaggtttccgcaccaagacccctttaactcaagactgcctcccgctttgtgtgccccgctccagcag

SEQ ID NO: 109 - DNA, 27 bp, Artificial Sequence
  Synthetic
  modified_base (1)..(1): methylated C nucleotide
  modified_base (5)..(5): methylated C nucleotide
  modified_base (12)..(12): methylated C nucleotide
  modified_base (14)..(14): methylated C nucleotide
  modified_base (20)..(20): methylated C nucleotide
  modified_base (24)..(24): methylated C nucleotide
  modified_base (26)..(26): methylated C nucleotide
cggccggggcccgcggtggcggccgcg

SEQ ID NO: 110 - DNA, 25 bp, Artificial Sequence
  Synthetic
  modified_base (3)..(3): methylated C nucleotide
  modified_base (18)..(18): methylated C nucleotide
  modified_base (20)..(20): methylated C nucleotide
  modified_base (22)..(22): methylated C nucleotide
gccgcatgaattaactacgcgcgcc

SEQ ID NO: 111 - DNA, 25 bp, Artificial Sequence
  Synthetic
  modified_base (3)..(3): methylated C nucleotide
  modified_base (10)..(10): methylated C nucleotide
  modified_base (22)..(22): methylated C nucleotide
gccggtgggcggagagattagcgag

SEQ ID NO: 112 - DNA, 29 bp, Artificial Sequence
  Synthetic
  modified_base (3)..(3): methylated C nucleotide
  modified_base (16)..(16): methylated C nucleotide
  modified_base (28)..(28): methylated C nucleotide
agcgatccctccctccgttctttttcccg

SEQ ID NO: 113 - DNA, 31 bp, Artificial Sequence
  Synthetic
  modified_base (2)..(2): methylated C nucleotide
  modified_base (29)..(29): methylated C nucleotide
tcgcagggggaacagctgccctccacaccga

SEQ ID NO: 114 - DNA, 27 bp, Artificial Sequence
  Synthetic
  modified_base (3)..(3): methylated C nucleotide
  modified_base (5)..(5): methylated C nucleotide
  modified_base (12)..(12): methylated C nucleotide
  modified_base (21)..(21): methylated C nucleotide
  modified_base (23)..(23): methylated C nucleotide
  modified_base (25)..(25): methylated C nucleotide
tgcgcgcccaccgccagccacgcgcgt

SEQ ID NO: 115 - DNA, 34 bp, Artificial Sequence
  Synthetic
  modified_base (4)..(4): methylated C nucleotide
  modified_base (9)..(9): methylated C nucleotide
  modified_base (30)..(30): methylated C nucleotide
  modified_base (32)..(32): methylated C nucleotide
gggcgcctcgctaaggctggggaaagggccgcgc

SEQ ID NO: 116 - DNA, 30 bp, Artificial Sequence
  Synthetic
ctactcctcgtagtgtttgacaaatcgcat

SEQ ID NO: 117 - DNA, 27 bp, Artificial Sequence
  Synthetic
ctcagccgggcagccgagcactctacc

SEQ ID NO: 118 - DNA, 34 bp, Artificial Sequence
  Synthetic
ccacgccctctgctttgggaacccgggagggcgc

SEQ ID NO: 119 - DNA, 28 bp, Artificial Sequence
  Synthetic
cgagttagataaagccccgaaaatcggc

SEQ ID NO: 120 - DNA, 33 bp, Artificial Sequence
  Synthetic
cggctcttccaccctaggcggccgcccgctcgc

SEQ ID NO: 121 - DNA, 24 bp, Artificial Sequence
  Synthetic
ggcgaagcccccgattcgctccgg

SEQ ID NO: 122 - DNA, 37 bp, Artificial Sequence
  Synthetic
  misc_feature (12)..(12): n is a, c, g, or t
gtctcctcgcgntcgggagactcgcgtccttgctcgg

SEQ ID NO: 123 - DNA, 37 bp, Artificial Sequence
  Synthetic
gccgcgggaggtggcggtgaggaatacaatttgcccg

SEQ ID NO: 124 - DNA, 36 bp, Artificial Sequence
  Synthetic
cgtcggccccgcagcggcagaggaatcgaaagcggc

SEQ ID NO: 125 - DNA, 30 bp, Artificial Sequence
  Synthetic
cttggtgcggaaacctggcgcagcgcgcag

SEQ ID NO: 126 - DNA, 25 bp, Artificial Sequence
  Synthetic
cagcacagctcgggggtcctcagcc

SEQ ID NO: 127 - DNA, 28 bp, Artificial Sequence
  Synthetic
cgtgaatgcggcaaggattgcggaccac

SEQ ID NO: 128 - DNA, 20 bp, Artificial Sequence
  Synthetic
gtgaccgccccgtgttatgg

SEQ ID NO: 129 - DNA, 22 bp, Artificial Sequence
  Synthetic
gtcgatggcgcaggagtgggag

SEQ ID NO: 130 - DNA, 31 bp, Artificial Sequence
  Synthetic
ctgctggagcggggcacacaaagcgggaggc

SEQ ID NO: 131 - DNA, 1314 bp, Homo sapiens
gagctccgggtacctggagaacatgaatctcccgggtgtactgtccccatgagggtcaccgaggaacctatggatcttccactcttcgcccagaatgtcttccctctatcccctccacctccccaaattccagcaccaggggccacctcagagccacaaatcctgaaaggaccacccaggtgactcgggcccacacacccctctttcggggtacacttggtggcaggctaggagcttttggcctcagctggtggtgccacacaccagattcgtcacagagacccattttttatcagtcccaggccagaagtacgaagactgatcttaacgatgtggcctgcctgggaggtaaggcggcaggcgttgcagaattgatgggaactgtggcacaggtgggaaacctggtttaacaaattcttcattgattcaggggaccactttccttgagccaagtcttggcaagcggccggcgaaactcacaggtccctttcctggctgcgtccccagcctccagccttccccgccccagagatgccccaggagcggcccctcggtgtaggtaacgggtgcccgggcggctccgtccgccgcctagagcctggaagccgccactgcggcccaggacaatccggctacgcggccggcgccgaccccgcacgctggagtccgctgccgcacggcgctggcagtcgggggtggtgtctgaagtcaggcgcttcctgccttttcgtcggcccgggtgcccggctcgcgccgccaggctctgggatcccaggtcgccccgcccagcagcccgcgccctgctcggtgcgctcagcgtccccgccccttaccccaaacccccaccctctgtgccctcaggggggcacccccatcggggcgggaggggggggtcagctgtgccccggtcgccgagtggcgaggaggtgacggtagccgccttcctatttccgcccggcgggcagcgctgcggggcgagtgccagcagagaggcgctcggtcctccctccgccctcccgcgccgggggcaggccctgcctagtctgcgtctttttcccccgcaccgcggcgccgctccgccactcgggcaccgcaggtagggcaggaggctggagagcctgctgcccgcccgcccgtaaaatggtcccctcggctggacagctcgccctgttcgctctgggtattgtgttggctgcgtgccaggccttggagaacagcacgtccccgctgagtgcagacccgcccgtggctgcagcagtggtgtcccattttaatgactgcccagattcccacactcagttctgcttccatgga

SEQ ID NO: 132 - DNA, 29 bp, Artificial Sequence
  Synthetic
  modified_base (2)..(2): methylated C nucleotide
  modified_base (5)..(5): methylated C nucleotide
  modified_base (7)..(7): methylated C nucleotide
  modified_base (15)..(15): methylated C nucleotide
  modified_base (27)..(27): methylated C nucleotide
ccggcgcgggagggcggagggaggaccgt

SEQ ID NO: 133 - DNA, 28 bp, Artificial Sequence
  Synthetic
  modified_base (2)..(2): methylated C nucleotide
  modified_base (7)..(7): methylated C nucleotide
  modified_base (12)..(12): methylated C nucleotide
  modified_base (19)..(19): methylated C nucleotide
  modified_base (22)..(22): methylated C nucleotide
  modified_base (26)..(26): methylated C nucleotide
tcgccccgcagcgctgcccgccgggcgg

SEQ ID NO: 134 - DNA, 26 bp, Artificial Sequence
  Synthetic
  modified_base (6)..(6): methylated C nucleotide
  modified_base (12)..(12): methylated C nucleotide
  modified_base (19)..(19): methylated C nucleotide
  modified_base (24)..(24): methylated C nucleotide
aggggcggggacgctgagcgcaccga

SEQ ID NO: 135 - DNA, 25 bp, Artificial Sequence
  Synthetic
  modified_base (5)..(5): methylated C nucleotide
  modified_base (7)..(7): methylated C nucleotide
  modified_base (19)..(19): methylated C nucleotide
  modified_base (23)..(23): methylated C nucleotide
agggcgcgggctgctgggcgggcga

SEQ ID NO: 136 - DNA, 35 bp, Artificial Sequence
  Synthetic
  modified_base (7)..(7): methylated C nucleotide
  modified_base (10)..(10): methylated C nucleotide
  modified_base (12)..(12): methylated C nucleotide
  modified_base (17)..(17): methylated C nucleotide
  modified_base (25)..(25): methylated C nucleotide
  modified_base (30)..(30): methylated C nucleotide
  modified_base (33)..(33): methylated C nucleotide
gcctggcggcgcgagccgggcacccgggccgacga

SEQ ID NO: 137 - DNA, 28 bp, Artificial Sequence
  Synthetic
  modified_base (3)..(3): methylated C nucleotide
  modified_base (7)..(7): methylated C nucleotide
  modified_base (13)..(13): methylated C nucleotide
  modified_base (16)..(16): methylated C nucleotide
  modified_base (19)..(19): methylated C nucleotide
  modified_base (23)..(23): methylated C nucleotide
  modified_base (25)..(25): methylated C nucleotide
agcgtgcggggtcggcgccggccgcgta

SEQ ID NO: 138 - DNA, 29 bp, Artificial Sequence
  Synthetic
  modified_base (2)..(2): methylated C nucleotide
  modified_base (5)..(5): methylated C nucleotide
  modified_base (9)..(9): methylated C nucleotide
  modified_base (15)..(15): methylated C nucleotide
  modified_base (19)..(19): methylated C nucleotide
  modified_base (27)..(27): methylated C nucleotide
gcggcggacggagccgcccgggcacccgt

SEQ ID NO: 139 - DNA, 33 bp, Artificial Sequence
  Synthetic
  modified_base (4)..(4): methylated C nucleotide
  modified_base (9)..(9): methylated C nucleotide
  modified_base (31)..(31): methylated C nucleotide
gggcggggcgacctgggatcccaggcctggcgg

SEQ ID NO: 140 - DNA, 26 bp, Artificial Sequence
  Synthetic
  modified_base (2)..(2): methylated C nucleotide
  modified_base (24)..(24): methylated C nucleotide
ccgctcctggggcatctctggggcgg

SEQ ID NO: 141 - DNA, 27 bp, Artificial Sequence
  Synthetic
  modified_base (2)..(2): methylated C nucleotide
  modified_base (6)..(6): methylated C nucleotide
  modified_base (10)..(10): methylated C nucleotide
acgggcgggcgggcagcaggctctcca

SEQ ID NO: 142 - DNA, 30 bp, Artificial Sequence
  Synthetic
  modified_base (2)..(2): methylated C nucleotide
  modified_base (28)..(28): methylated C nucleotide
ccgccttacctcccaggcaggccacatcgt

SEQ ID NO: 143 - DNA, 25 bp, Artificial Sequence
  Synthetic
  modified_base (2)..(2): methylated C nucleotide
  modified_base (23)..(23): methylated C nucleotide
ccgaaagaggggtgtgtgggcccga

SEQ ID NO: 144 - DNA, 31 bp, Artificial Sequence
  Synthetic
  modified_base (2)..(2): methylated C nucleotide
  modified_base (9)..(9): methylated C nucleotide
  modified_base (16)..(16): methylated C nucleotide
  modified_base (21)..(21): methylated C nucleotide
  modified_base (24)..(24): methylated C nucleotide
  modified_base (27)..(27): methylated C nucleotide
  modified_base (29)..(29): methylated C nucleotide
gcggtgcccgagtggcggagcggcgccgcgg

SEQ ID NO: 145 - DNA, 25 bp, Artificial Sequence
  Synthetic
catgttctccaggtacccggagctc

SEQ ID NO: 146 - DNA, 31 bp, Artificial Sequence
  Synthetic
cggtgaccctcatggggacagtacacccggg

SEQ ID NO: 147 - DNA, 30 bp, Artificial Sequence
  Synthetic
gatagagggaagacattctgggcgaagagt

SEQ ID NO: 148 - DNA, 28 bp, Artificial Sequence
  Synthetic
gtgagtttcgccggccgcttgccaagac

SEQ ID NO: 149 - DNA, 27 bp, Artificial Sequence
  Synthetic
ccgcgtagccggattgtcctgggccgc

SEQ ID NO: 150 - DNA, 21 bp, Artificial Sequence
  Synthetic
cgccgtgcggcagcggactcc

SEQ ID NO: 151 - DNA, 26 bp, Artificial Sequence
  Synthetic
gcgcctgacttcagacaccacccccg

SEQ ID NO: 152 - DNA, 37 bp, Artificial Sequence
  Synthetic
gcgaccggggcacagctgacccccccctcccgccccg

SEQ ID NO: 153 - DNA, 28 bp, Artificial Sequence
  Synthetic
gcggctaccgtcacctcctcgccactcg

SEQ ID NO: 154 - DNA, 25 bp, Artificial Sequence
  Synthetic
gcgaacagggcgagctgtccagccg

SEQ ID NO: 155 - DNA, 25 bp, Artificial Sequence
  Synthetic
gccacgggcgggtctgcactcagcg

SEQ ID NO: 156 - DNA, 28 bp, Artificial Sequence
  Synthetic
gggtctctgtgacgaatctggtgtgtgg

SEQ ID NO: 157 - DNA, 24 bp, Artificial Sequence
  Synthetic
cagttcccatcaattctgcaacgc

SEQ ID NO: 158 - DNA, 25 bp, Artificial Sequence
  Synthetic
gcgggggaaaaagacgcagactagg

SEQ ID NO: 159 - DNA, 31 bp, Artificial Sequence
  Synthetic
gacgtgctgttctccaaggcctggcacgcag

SEQ ID NO: 160-162 - skipped (3 entries)

SEQ ID NO: 163 - DNA, 24 bp, Artificial Sequence
  Synthetic
  modified_base (3)..(3): methylated C nucleotide
  modified_base (7)..(7): methylated C nucleotide
  modified_base (9)..(9): methylated C nucleotide
  modified_base (17)..(17): methylated C nucleotide
  modified_base (21)..(21): methylated C nucleotide
cacgcacgcgcatccccgcccgtg

SEQ ID NO: 164 - DNA, 25 bp, Artificial Sequence
  Synthetic
  modified_base (4)..(4): methylated C nucleotide
  modified_base (8)..(8): methylated C nucleotide
  modified_base (10)..(10): methylated C nucleotide
  modified_base (18)..(18): methylated C nucleotide
  modified_base (22)..(22): methylated C nucleotide
acacgcacgcgcatccccgcccgtg

SEQ ID NO: 165 - DNA, 26 bp, Artificial Sequence
  Synthetic
  modified_base (5)..(5): methylated C nucleotide
  modified_base (9)..(9): methylated C nucleotide
  modified_base (11)..(11): methylated C nucleotide
  modified_base (19)..(19): methylated C nucleotide
  modified_base (23)..(23): methylated C nucleotide
cacacgcacgcgcatccccgcccgtg

SEQ ID NO: 166 - DNA, 27 bp, Artificial Sequence
  Synthetic
  modified_base (6)..(6): methylated C nucleotide
  modified_base (10)..(10): methylated C nucleotide
  modified_base (12)..(12): methylated C nucleotide
  modified_base (20)..(20): methylated C nucleotide
  modified_base (24)..(24): methylated C nucleotide
acacacgcacgcgcatccccgcccgtg

SEQ ID NO: 167 - DNA, 28 bp, Artificial Sequence
  Synthetic
  modified_base (7)..(7): methylated C nucleotide
  modified_base (11)..(11): methylated C nucleotide
  modified_base (13)..(13): methylated C nucleotide
  modified_base (21)..(21): methylated C nucleotide
  modified_base (25)..(25): methylated C nucleotide
tacacacgcacgcgcatccccgcccgtg

SEQ ID NO: 168 - DNA, 29 bp, Artificial Sequence
  Synthetic
  modified_base (8)..(8): methylated C nucleotide
  modified_base (12)..(12): methylated C nucleotide
  modified_base (14)..(14): methylated C nucleotide
  modified_base (22)..(22): methylated C nucleotide
  modified_base (26)..(26): methylated C nucleotide
ctacacacgcacgcgcatccccgcccgtg

SEQ ID NO: 169 - DNA, 25 bp, Artificial Sequence
  Synthetic
  modified_base (3)..(3): methylated C nucleotide
  modified_base (7)..(7): methylated C nucleotide
  modified_base (9)..(9): methylated C nucleotide
  modified_base (17)..(17): methylated C nucleotide
  modified_base (21)..(21): methylated C nucleotide
cacgcacgcgcatccccgcccgtgt

SEQ ID NO: 170 - DNA, 26 bp, Artificial Sequence
  Synthetic
  modified_base (3)..(3): methylated C nucleotide
  modified_base (7)..(7): methylated C nucleotide
  modified_base (9)..(9): methylated C nucleotide
  modified_base (17)..(17): methylated C nucleotide
  modified_base (21)..(21): methylated C nucleotide
cacgcacgcgcatccccgcccgtgtc

SEQ ID NO: 171 - DNA, 27 bp, Artificial Sequence
  Synthetic
  modified_base (3)..(3): methylated C nucleotide
  modified_base (7)..(7): methylated C nucleotide
  modified_base (9)..(9): methylated C nucleotide
  modified_base (17)..(17): methylated C nucleotide
  modified_base (21)..(21): methylated C nucleotide
cacgcacgcgcatccccgcccgtgtcc

SEQ ID NO: 172 - DNA, 28 bp, Artificial Sequence
  Synthetic
  modified_base (3)..(3): methylated C nucleotide
  modified_base (7)..(7): methylated C nucleotide
  modified_base (9)..(9): methylated C nucleotide
  modified_base (17)..(17): methylated C nucleotide
  modified_base (21)..(21): methylated C nucleotide
cacgcacgcgcatccccgcccgtgtcca

SEQ ID NO: 173 - DNA, 29 bp, Artificial Sequence
  Synthetic
  modified_base (3)..(3): methylated C nucleotide
  modified_base (7)..(7): methylated C nucleotide
  modified_base (9)..(9): methylated C nucleotide
  modified_base (17)..(17): methylated C nucleotide
  modified_base (21)..(21): methylated C nucleotide
cacgcacgcgcatccccgcccgtgtccac

SEQ ID NO: 174 - DNA, 26 bp, Artificial Sequence
  Synthetic
  modified_base (4)..(4): methylated C nucleotide
  modified_base (8)..(8): methylated C nucleotide
  modified_base (10)..(10): methylated C nucleotide
  modified_base (18)..(18): methylated C nucleotide
  modified_base (22)..(22): methylated C nucleotide
acacgcacgcgcatccccgcccgtgt

SEQ ID NO: 175 - DNA, 28 bp, Artificial Sequence
  Synthetic
  modified_base (5)..(5): methylated C nucleotide
  modified_base (9)..(9): methylated C nucleotide
  modified_base (11)..(11): methylated C nucleotide
  modified_base (19)..(19): methylated C nucleotide
  modified_base (23)..(23): methylated C nucleotide
cacacgcacgcgcatccccgcccgtgtc

SEQ ID NO: 176 - DNA, 30 bp, Artificial Sequence
  Synthetic
  modified_base (6)..(6): methylated C nucleotide
  modified_base (10)..(10): methylated C nucleotide
  modified_base (12)..(12): methylated C nucleotide
  modified_base (20)..(20): methylated C nucleotide
  modified_base (24)..(24): methylated C nucleotide
acacacgcacgcgcatccccgcccgtgtcc

SEQ ID NO: 177 - DNA, 32 bp, Artificial Sequence
  Synthetic
  modified_base (7)..(7): methylated C nucleotide
  modified_base (11)..(11): methylated C nucleotide
  modified_base (13)..(13): methylated C nucleotide
  modified_base (21)..(21): methylated C nucleotide
  modified_base (25)..(25): methylated C nucleotide
tacacacgcacgcgcatccccgcccgtgtcca

SEQ ID NO: 178 - DNA, 34 bp, Artificial Sequence
  Synthetic
  modified_base (8)..(8): methylated C nucleotide
  modified_base (12)..(12): methylated C nucleotide
  modified_base (14)..(14): methylated C nucleotide
  modified_base (22)..(22): methylated C nucleotide
  modified_base (26)..(26): methylated C nucleotide
ctacacacgcacgcgcatccccgcccgtgtccac

SEQ ID NO: 179 - DNA, 24 bp, Artificial Sequence
  Synthetic
  modified_base (6)..(6): methylated C nucleotide
  modified_base (10)..(10): methylated C nucleotide
  modified_base (12)..(12): methylated C nucleotide
  modified_base (20)..(20): methylated C nucleotide
  modified_base (24)..(24): methylated C nucleotide
acacacgcacgcgcatccccgccc

SEQ ID NO: 180 - DNA, 24 bp, Artificial Sequence
  Synthetic
  modified_base (9)..(9): methylated C nucleotide
  modified_base (13)..(13): methylated C nucleotide
  modified_base (15)..(15): methylated C nucleotide
  modified_base (23)..(23): methylated C nucleotide
actacacacgcacgcgcatccccg

SEQ ID NO: 181 - DNA, 24 bp, Artificial Sequence
  Synthetic
  modified_base (12)..(12): methylated C nucleotide
  modified_base (16)..(16): methylated C nucleotide
  modified_base (18)..(18): methylated C nucleotide
cgcactacacacgcacgcgcatcc

SEQ ID NO: 182 - DNA, 24 bp, Artificial Sequence
  Synthetic
  modified_base (15)..(15): methylated C nucleotide
  modified_base (19)..(19): methylated C nucleotide
  modified_base (21)..(21): methylated C nucleotide
ccgcgcactacacacgcacgcgca

SEQ ID NO: 183 - DNA, 24 bp, Artificial Sequence
  Synthetic
  modified_base (18)..(18): methylated C nucleotide
  modified_base (22)..(22): methylated C nucleotide
  modified_base (24)..(24): methylated C nucleotide
tgtccgcgcactacacacgcacgc

SEQ ID NO: 184 - DNA, 24 bp, Artificial Sequence
  Synthetic
  modified_base (4)..(4): methylated C nucleotide
  modified_base (6)..(6): methylated C nucleotide
  modified_base (14)..(14): methylated C nucleotide
  modified_base (18)..(18): methylated C nucleotide
gcacgcgcatccccgcccgtgtcc

SEQ ID NO: 185 - DNA, 24 bp, Artificial Sequence
  Synthetic
  modified_base (1)..(1): methylated C nucleotide
  modified_base (3)..(3): methylated C nucleotide
  modified_base (11)..(11): methylated C nucleotide
  modified_base (15)..(15): methylated C nucleotide
cgcgcatccccgcccgtgtccacc

SEQ ID NO: 186 - DNA, 24 bp, Artificial Sequence
  Synthetic
  modified_base (8)..(8): methylated C nucleotide
  modified_base (12)..(12): methylated C nucleotide
gcatccccgcccgtgtccacctga

SEQ ID NO: 187 - DNA, 24 bp, Artificial Sequence
  Synthetic
  modified_base (5)..(5): methylated C nucleotide
  modified_base (9)..(9): methylated C nucleotide
tccccgcccgtgtccacctgaaca

SEQ ID NO: 188 - DNA, 24 bp, Artificial Sequence
  Synthetic
  modified_base (2)..(2): methylated C nucleotide
  modified_base (6)..(6): methylated C nucleotide
ccgcccgtgtccacctgaacacct

SEQ ID NO: 189 - DNA, 22 bp, Artificial Sequence
  Synthetic
  modified_base (1)..(1): methylated C nucleotide
  modified_base (5)..(5): methylated C nucleotide
  modified_base (7)..(7): methylated C nucleotide
  modified_base (15)..(15): methylated C nucleotide
  modified_base (19)..(19): methylated C nucleotide
cgcacgcgcatccccgcccgtg

SEQ ID NO: 190 - DNA, 20 bp, Artificial Sequence
  Synthetic
  modified_base (3)..(3): methylated C nucleotide
  modified_base (5)..(5): methylated C nucleotide
  modified_base (13)..(13): methylated C nucleotide
  modified_base (17)..(17): methylated C nucleotide
cacgcgcatccccgcccgtg

SEQ ID NO: 191 - DNA, 18 bp, Artificial Sequence
  Synthetic
  modified_base (1)..(1): methylated C nucleotide
  modified_base (3)..(3): methylated C nucleotide
  modified_base (11)..(11): methylated C nucleotide
  modified_base (15)..(15): methylated C nucleotide
cgcgcatccccgcccgtg

SEQ ID NO: 192 - DNA, 16 bp, Artificial Sequence
  Synthetic
  modified_base (1)..(1): methylated C nucleotide
  modified_base (9)..(9): methylated C nucleotide
  modified_base (13)..(13): methylated C nucleotide
cgcatccccgcccgtg

SEQ ID NO: 193 - DNA, 15 bp, Artificial Sequence
  Synthetic
  modified_base (8)..(8): methylated C nucleotide
  modified_base (12)..(12): methylated C nucleotide
gcatccccgcccgtg

SEQ ID NO: 194 - DNA, 22 bp, Artificial Sequence
  Synthetic
  modified_base (3)..(3): methylated C nucleotide
  modified_base (7)..(7): methylated C nucleotide
  modified_base (9)..(9): methylated C nucleotide
  modified_base (17)..(17): methylated C nucleotide
  modified_base (21)..(21): methylated C nucleotide
cacgcacgcgcatccccgcccg

SEQ ID NO: 195 - DNA, 20 bp, Artificial Sequence
  Synthetic
  modified_base (3)..(3): methylated C nucleotide
  modified_base (7)..(7): methylated C nucleotide
  modified_base (9)..(9): methylated C nucleotide
  modified_base (17)..(17): methylated C nucleotide
cacgcacgcgcatccccgcc

SEQ ID NO: 196 - DNA, 18 bp, Artificial Sequence
  Synthetic
  modified_base (3)..(3): methylated C nucleotide
  modified_base (7)..(7): methylated C nucleotide
  modified_base (9)..(9): methylated C nucleotide
  modified_base (17)..(17): methylated C nucleotide
cacgcacgcgcatccccg

SEQ ID NO: 197 - DNA, 16 bp, Artificial Sequence
  Synthetic
  modified_base (3)..(3): methylated C nucleotide
  modified_base (7)..(7): methylated C nucleotide
  modified_base (9)..(9): methylated C nucleotide
cacgcacgcgcatccc

SEQ ID NO: 198 - DNA, 15 bp, Artificial Sequence
  Synthetic
  modified_base (3)..(3): methylated C nucleotide
  modified_base (7)..(7): methylated C nucleotide
  modified_base (9)..(9): methylated C nucleotide
cacgcacgcgcatcc

SEQ ID NO: 199 - DNA, 24 bp, Artificial Sequence
  Synthetic
  modified_base (3)..(3): methylated C nucleotide
  modified_base (7)..(7): methylated C nucleotide
  modified_base (9)..(9): methylated C nucleotide
  modified_base (17)..(17): methylated C nucleotide
  modified_base (21)..(21): methylated C nucleotide
cacgcacgcgtatccccgcccgtg

SEQ ID NO: 200 - DNA, 24 bp, Artificial Sequence
  Synthetic
  modified_base (3)..(3): methylated C nucleotide
  modified_base (7)..(7): methylated C nucleotide
  modified_base (9)..(9): methylated C nucleotide
  modified_base (17)..(17): methylated C nucleotide
  modified_base (21)..(21): methylated C nucleotide
cacgcgcgcgcatccccgcccgtg

SEQ ID NO: 201 - DNA, 24 bp, Artificial Sequence
  Synthetic
  modified_base (3)..(3): methylated C nucleotide
  modified_base (7)..(7): methylated C nucleotide
  modified_base (9)..(9): methylated C nucleotide
  modified_base (17)..(17): methylated C nucleotide
  modified_base (21)..(21): methylated C nucleotide
cacgcacgcgcatccccgaccgtg

SEQ ID NO: 202 - DNA, 26 bp, Artificial Sequence
  Synthetic
  modified_base (3)..(3): methylated C nucleotide
  modified_base (7)..(7): methylated C nucleotide
  modified_base (12)..(12): methylated C nucleotide
  modified_base (17)..(17): methylated C nucleotide
  modified_base (21)..(21): methylated C nucleotide
  modified_base (23)..(23): methylated C nucleotide
cccgcccgctccgctgcgcccgcggg

SEQ ID NO: 203 - DNA, 27 bp, Artificial Sequence
  Synthetic
  modified_base (4)..(4): methylated C nucleotide
  modified_base (8)..(8): methylated C nucleotide
  modified_base (13)..(13): methylated C nucleotide
  modified_base (18)..(18): methylated C nucleotide
  modified_base (22)..(22): methylated C nucleotide
  modified_base (24)..(24): methylated C nucleotide
acccgcccgctccgctgcgcccgcggg

SEQ ID NO: 204 - DNA, 28 bp, Artificial Sequence
  Synthetic
  modified_base (5)..(5): methylated C nucleotide
  modified_base (9)..(9): methylated C nucleotide
  modified_base (14)..(14): methylated C nucleotide
  modified_base (19)..(19): methylated C nucleotide
  modified_base (23)..(23): methylated C nucleotide
  modified_base (25)..(25): methylated C nucleotide
cacccgcccgctccgctgcgcccgcggg

SEQ ID NO: 205 - DNA, 29 bp, Artificial Sequence
  Synthetic
  modified_base (6)..(6): methylated C nucleotide
  modified_base (10)..(10): methylated C nucleotide
  modified_base (15)..(15): methylated C nucleotide
  modified_base (20)..(20): methylated C nucleotide
  modified_base (24)..(24): methylated C nucleotide
  modified_base (26)..(26): methylated C nucleotide
ccacccgcccgctccgctgcgcccgcggg

SEQ ID NO: 206 - DNA, 30 bp, Artificial Sequence
  Synthetic
  modified_base (7)..(7): methylated C nucleotide
  modified_base (11)..(11): methylated C nucleotide
  modified_base (16)..(16): methylated C nucleotide
  modified_base (21)..(21): methylated C nucleotide
  modified_base (25)..(25): methylated C nucleotide
  modified_base (27)..(27): methylated C nucleotide
gccacccgcccgctccgctgcgcccgcggg

SEQ ID NO: 207 - DNA, 31 bp, Artificial Sequence
  Synthetic
  modified_base (8)..(8): methylated C nucleotide
  modified_base (12)..(12): methylated C nucleotide
  modified_base (17)..(17): methylated C nucleotide
  modified_base (22)..(22): methylated C nucleotide
  modified_base (26)..(26): methylated C nucleotide
  modified_base (28)..(28): methylated C nucleotide
ggccacccgcccgctccgctgcgcccgcggg

SEQ ID NO: 208 - DNA, 27 bp, Artificial Sequence
  Synthetic
  modified_base (3)..(3): methylated C nucleotide
  modified_base (7)..(7): methylated C nucleotide
  modified_base (12)..(12): methylated C nucleotide
  modified_base (17)..(17): methylated C nucleotide
  modified_base (21)..(21): methylated C nucleotide
  modified_base (23)..(23): methylated C nucleotide
cccgcccgctccgctgcgcccgcgggg

SEQ ID NO: 209 - DNA, 28 bp, Artificial Sequence
  Synthetic
  modified_base (3)..(3): methylated C nucleotide
  modified_base (7)..(7): methylated C nucleotide
  modified_base (12)..(12): methylated C nucleotide
  modified_base (17)..(17): methylated C nucleotide
  modified_base (21)..(21): methylated C nucleotide
  modified_base (23)..(23): methylated C nucleotide
cccgcccgctccgctgcgcccgcggggc

SEQ ID NO: 210 - DNA, 29 bp, Artificial Sequence
  Synthetic
  modified_base (3)..(3): methylated C nucleotide
  modified_base (7)..(7): methylated C nucleotide
  modified_base (12)..(12): methylated C nucleotide
  modified_base (17)..(17): methylated C nucleotide
  modified_base (21)..(21): methylated C nucleotide
  modified_base (23)..(23): methylated C nucleotide
cccgcccgctccgctgcgcccgcggggcc

SEQ ID NO: 211 - DNA, 30 bp, Artificial Sequence
  Synthetic
  modified_base (3)..(3): methylated C nucleotide
  modified_base (7)..(7): methylated C nucleotide
  modified_base (12)..(12): methylated C nucleotide
  modified_base (17)..(17): methylated C nucleotide
  modified_base (21)..(21): methylated C nucleotide
  modified_base (23)..(23): methylated C nucleotide
cccgcccgctccgctgcgcccgcggggccc

SEQ ID NO: 212 - DNA, 31 bp, Artificial Sequence
  Synthetic
  modified_base (3)..(3): methylated C nucleotide
  modified_base (7)..(7): methylated C nucleotide
  modified_base (12)..(12): methylated C nucleotide
  modified_base (17)..(17): methylated C nucleotide
  modified_base (21)..(21): methylated C nucleotide
  modified_base (23)..(23): methylated C nucleotide
cccgcccgctccgctgcgcccgcggggcccg

SEQ ID NO: 213 - DNA, 28 bp, Artificial Sequence
  Synthetic
  modified_base (4)..(4): methylated C nucleotide
  modified_base (8)..(8): methylated C nucleotide
  modified_base (13)..(13): methylated C nucleotide
  modified_base (18)..(18): methylated C nucleotide
  modified_base (22)..(22): methylated C nucleotide
  modified_base (24)..(24): methylated C nucleotide
acccgcccgctccgctgcgcccgcgggg

SEQ ID NO: 214 - DNA, 30 bp, Artificial Sequence
  Synthetic
  modified_base (5)..(5): methylated C nucleotide
  modified_base (9)..(9): methylated C nucleotide
  modified_base (14)..(14): methylated C nucleotide
  modified_base (19)..(19): methylated C nucleotide
  modified_base (23)..(23): methylated C nucleotide
  modified_base (25)..(25): methylated C nucleotide
cacccgcccgctccgctgcgcccgcggggc

SEQ ID NO: 215 - DNA, 32 bp, Artificial Sequence
  Synthetic
  modified_base (6)..(6): methylated C nucleotide
  modified_base (10)..(10): methylated C nucleotide
  modified_base (15)..(15): methylated C nucleotide
  modified_base (20)..(20): methylated C nucleotide
  modified_base (24)..(24): methylated C nucleotide
  modified_base (26)..(26): methylated C nucleotide
ccacccgcccgctccgctgcgcccgcggggcc

SEQ ID NO: 216 - DNA, 34 bp, Artificial Sequence
  Synthetic
  modified_base (7)..(7): methylated C nucleotide
  modified_base (11)..(11): methylated C nucleotide
  modified_base (16)..(16): methylated C nucleotide
  modified_base (21)..(21): methylated C nucleotide
  modified_base (25)..(25): methylated C nucleotide
  modified_base (27)..(27): methylated C nucleotide
gccacccgcccgctccgctgcgcccgcggggccc

SEQ ID NO: 217 - DNA, 36 bp, Artificial Sequence
  Synthetic
  modified_base (8)..(8): methylated C nucleotide
  modified_base (12)..(12): methylated C nucleotide
  modified_base (17)..(17): methylated C nucleotide
  modified_base (22)..(22): methylated C nucleotide
  modified_base (26)..(26): methylated C nucleotide
  modified_base (28)..(28): methylated C nucleotide
ggccacccgcccgctccgctgcgcccgcggggcccg

SEQ ID NO: 218 - DNA, 26 bp, Artificial Sequence
  Synthetic
  modified_base (8)..(8): methylated C nucleotide
  modified_base (10)..(10): methylated C nucleotide
  modified_base (15)..(15): methylated C nucleotide
  modified_base (20)..(20): methylated C nucleotide
  modified_base (24)..(24): methylated C nucleotide
  modified_base (26)..(26): methylated C nucleotide
ccacccgcccgctccgctgcgcccgc

SEQ ID NO: 219 - DNA, 26 bp, Artificial Sequence
  Synthetic
  modified_base (9)..(9): methylated C nucleotide
  modified_base (13)..(13): methylated C nucleotide
  modified_base (18)..(18): methylated C nucleotide
  modified_base (23)..(23): methylated C nucleotide
cggccacccgcccgctccgctgcgcc

SEQ ID NO: 220 - DNA, 26 bp, Artificial Sequence
  Synthetic
  modified_base (12)..(12): methylated C nucleotide
  modified_base (16)..(16): methylated C nucleotide
  modified_base (21)..(21): methylated C nucleotide
  modified_base (26)..(26): methylated C nucleotide
ggccggccacccgcccgctccgctgc

SEQ ID NO: 221 - DNA, 26 bp, Artificial Sequence
  Synthetic
  modified_base (15)..(15): methylated C nucleotide
  modified_base (19)..(19): methylated C nucleotide
  modified_base (24)..(24): methylated C nucleotide
ccgggccggccacccgcccgctccgc

SEQ ID NO: 222 - DNA, 26 bp, Artificial Sequence
  Synthetic
  modified_base (18)..(18): methylated C nucleotide
  modified_base (22)..(22): methylated C nucleotide
cctccgggccggccacccgcccgctc

SEQ ID NO: 223 - DNA, 26 bp, Artificial Sequence
  Synthetic
  modified_base (4)..(4): methylated C nucleotide
  modified_base (9)..(9): methylated C nucleotide
  modified_base (14)..(14): methylated C nucleotide
  modified_base (18)..(18): methylated C nucleotide
  modified_base (20)..(20): methylated C nucleotide
gcccgctccgctgcgcccgcggggcc

SEQ ID NO: 224 - DNA, 26 bp, Artificial Sequence
  Synthetic
  modified_base (1)..(1): methylated C nucleotide
  modified_base (6)..(6): methylated C nucleotide
  modified_base (11)..(11): methylated C nucleotide
  modified_base (15)..(15): methylated C nucleotide
  modified_base (17)..(17): methylated C nucleotide
cgctccgctgcgcccgcggggcccgg

SEQ ID NO: 225 - DNA, 26 bp, Artificial Sequence
  Synthetic
  modified_base (3)..(3): methylated C nucleotide
  modified_base (8)..(8): methylated C nucleotide
  modified_base (12)..(12): methylated C nucleotide
  modified_base (14)..(14): methylated C nucleotide
tccgctgcgcccgcggggcccggcca

SEQ ID NO: 226 - DNA, 26 bp, Artificial Sequence
  Synthetic
  modified_base (5)..(5): methylated C nucleotide
  modified_base (9)..(9): methylated C nucleotide
  modified_base (11)..(11): methylated C nucleotide
gctgcgcccgcggggcccggccagtg

SEQ ID NO: 227 - DNA, 26 bp, Artificial Sequence
  Synthetic
  modified_base (2)..(2): methylated C nucleotide
  modified_base (6)..(6): methylated C nucleotide
  modified_base (8)..(8): methylated C nucleotide
gcgcccgcggggcccggccagtgggt

SEQ ID NO: 228 - DNA, 24 bp, Artificial Sequence
  Synthetic
  modified_base (1)..(1): methylated C nucleotide
  modified_base (5)..(5): methylated C nucleotide
  modified_base (10)..(10): methylated C nucleotide
  modified_base (15)..(15): methylated C nucleotide
  modified_base (19)..(19): methylated C nucleotide
  modified_base (21)..(21): methylated C nucleotide
cgcccgctccgctgcgcccgcggg

SEQ ID NO: 229 - DNA, 22 bp, Artificial Sequence
  Synthetic
  modified_base (3)..(3): methylated C nucleotide
  modified_base (8)..(8): methylated C nucleotide
  modified_base (13)..(13): methylated C nucleotide
  modified_base (17)..(17): methylated C nucleotide
  modified_base (19)..(19): methylated C nucleotide
cccgctccgctgcgcccgcggg

SEQ ID NO: 230 - DNA, 20 bp, Artificial Sequence
  Synthetic
  modified_base (1)..(1): methylated C nucleotide
  modified_base (6)..(6): methylated C nucleotide
  modified_base (11)..(11): methylated C nucleotide
  modified_base (15)..(15): methylated C nucleotide
  modified_base (17)..(17): methylated C nucleotide
cgctccgctgcgcccgcggg

SEQ ID NO: 231 - DNA, 18 bp, Artificial Sequence
  Synthetic
  modified_base (4)..(4): methylated C nucleotide
  modified_base (9)..(9): methylated C nucleotide
  modified_base (13)..(13): methylated C nucleotide
  modified_base (15)..(15): methylated C nucleotide
ctccgctgcgcccgcggg

SEQ ID NO: 232 - DNA, 16 bp, Artificial Sequence
  Synthetic
  modified_base (2)..(2): methylated C nucleotide
  modified_base (7)..(7): methylated C nucleotide
  modified_base (11)..(11): methylated C nucleotide
  modified_base (13)..(13): methylated C nucleotide
ccgctgcgcccgcggg

SEQ ID NO: 233 - DNA, 15 bp, Artificial Sequence
  Synthetic
  modified_base (1)..(1): methylated C nucleotide
  modified_base (6)..(6): methylated C nucleotide
  modified_base (10)..(10): methylated C nucleotide
  modified_base (12)..(12): methylated C nucleotide
cgctgcgcccgcggg

SEQ ID NO: 234 - DNA, 24 bp, Artificial Sequence
  Synthetic
  modified_base (3)..(3): methylated C nucleotide
  modified_base (7)..(7): methylated C nucleotide
  modified_base (12)..(12): methylated C nucleotide
  modified_base (17)..(17): methylated C nucleotide
  modified_base (21)..(21): methylated C nucleotide
  modified_base (23)..(23): methylated C nucleotide
cccgcccgctccgctgcgcccgcg

SEQ ID NO: 235 - DNA, 22 bp, Artificial Sequence
  Synthetic
  modified_base (3)..(3): methylated C nucleotide
  modified_base (7)..(7): methylated C nucleotide
  modified_base (12)..(12): methylated C nucleotide
  modified_base (17)..(17): methylated C nucleotide
  modified_base (21)..(21): methylated C nucleotide
cccgcccgctccgctgcgcccg

SEQ ID NO: 236 - DNA, 20 bp, Artificial Sequence
  Synthetic
  modified_base (3)..(3): methylated C nucleotide
  modified_base (7)..(7): methylated C nucleotide
  modified_base (12)..(12): methylated C nucleotide
  modified_base (17)..(17): methylated C nucleotide
cccgcccgctccgctgcgcc

SEQ ID NO: 237 - DNA, 18 bp, Artificial Sequence
  Synthetic
  modified_base (3)..(3): methylated C nucleotide
  modified_base (7)..(7): methylated C nucleotide
  modified_base (12)..(12): methylated C nucleotide
  modified_base (17)..(17): methylated C nucleotide
cccgcccgctccgctgcg

SEQ ID NO: 238 - DNA, 16 bp, Artificial Sequence
  Synthetic
  modified_base (3)..(3): methylated C nucleotide
  modified_base (7)..(7): methylated C nucleotide
  modified_base (12)..(12): methylated C nucleotide
cccgcccgctccgctg

SEQ ID NO: 239 - DNA, 15 bp, Artificial Sequence
  Synthetic
  modified_base (3)..(3): methylated C nucleotide
  modified_base (7)..(7): methylated C nucleotide
  modified_base (12)..(12): methylated C nucleotide
cccgcccgctccgct

SEQ ID NO: 240 - DNA, 26 bp, Artificial Sequence
  Synthetic
  modified_base (3)..(3): methylated C nucleotide
  modified_base (7)..(7): methylated C nucleotide
  modified_base (12)..(12): methylated C nucleotide
  modified_base (17)..(17): methylated C nucleotide
  modified_base (21)..(21): methylated C nucleotide
  modified_base (23)..(23): methylated C nucleotide
cccgcccgccccgctgcgcccgcggg

SEQ ID NO: 241 - DNA, 26 bp, Artificial Sequence
  Synthetic
  modified_base (3)..(3): methylated C nucleotide
  modified_base (7)..(7): methylated C nucleotide
  modified_base (12)..(12): methylated C nucleotide
  modified_base (17)..(17): methylated C nucleotide
  modified_base (21)..(21): methylated C nucleotide
  modified_base (23)..(23): methylated C nucleotide
cccgtccgctccgctgcgcccgcggg

SEQ ID NO: 242 - DNA, 26 bp, Artificial Sequence
  Synthetic
  modified_base (3)..(3): methylated C nucleotide
  modified_base (7)..(7): methylated C nucleotide
  modified_base (12)..(12): methylated C nucleotide
  modified_base (17)..(17): methylated C nucleotide
  modified_base (21)..(21): methylated C nucleotide
  modified_base (23)..(23): methylated C nucleotide
cccgcccgctccgctgcggccgcggg

SEQ ID NO: 243 - DNA, 21 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (13)..(13): methylated C nucleotide
  modified_base (18)..(18): methylated C nucleotide
ggcgcgcggggccgggccggg

SEQ ID NO: 244 - DNA, 22 bp, Artificial Sequence
  Synthetic
  modified_base (4)..(4): methylated C nucleotide
  modified_base (6)..(6): methylated C nucleotide
  modified_base (8)..(8): methylated C nucleotide
  modified_base (14)..(14): methylated C nucleotide
  modified_base (19)..(19): methylated C nucleotide
tggcgcgcggggccgggccggg

SEQ ID NO: 245 - DNA, 23 bp, Artificial Sequence
  Synthetic
  modified_base (5)..(5): methylated C nucleotide
  modified_base (7)..(7): methylated C nucleotide
  modified_base (9)..(9): methylated C nucleotide
  modified_base (15)..(15): methylated C nucleotide
  modified_base (20)..(20): methylated C nucleotide
atggcgcgcggggccgggccggg

SEQ ID NO: 246 - DNA, 24 bp, Artificial Sequence
  Synthetic
  modified_base (6)..(6): methylated C nucleotide
  modified_base (8)..(8): methylated C nucleotide
  modified_base (10)..(10): methylated C nucleotide
  modified_base (16)..(16): methylated C nucleotide
  modified_base (21)..(21): methylated C nucleotide
catggcgcgcggggccgggccggg

SEQ ID NO: 247 - DNA, 25 bp, Artificial Sequence
  Synthetic
  modified_base (7)..(7): methylated C nucleotide
  modified_base (9)..(9): methylated C nucleotide
  modified_base (11)..(11): methylated C nucleotide
  modified_base (17)..(17): methylated C nucleotide
  modified_base (22)..(22): methylated C nucleotide
acatggcgcgcggggccgggccggg

SEQ ID NO: 248 - DNA, 26 bp, Artificial Sequence
  Synthetic
  modified_base (8)..(8): methylated C nucleotide
  modified_base (10)..(10): methylated C nucleotide
  modified_base (12)..(12): methylated C nucleotide
  modified_base (18)..(18): methylated C nucleotide
  modified_base (23)..(23): methylated C nucleotide
cacatggcgcgcggggccgggccggg

SEQ ID NO: 249 - DNA, 22 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (13)..(13): methylated C nucleotide
  modified_base (18)..(18): methylated C nucleotide
ggcgcgcggggccgggccgggg

SEQ ID NO: 250 - DNA, 23 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (13)..(13): methylated C nucleotide
  modified_base (18)..(18): methylated C nucleotide
ggcgcgcggggccgggccgggga

SEQ ID NO: 251 - DNA, 24 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (13)..(13): methylated C nucleotide
  modified_base (18)..(18): methylated C nucleotide
ggcgcgcggggccgggccggggag

SEQ ID NO: 252 - DNA, 25 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (13)..(13): methylated C nucleotide
  modified_base (18)..(18): methylated C nucleotide
ggcgcgcggggccgggccggggagg

SEQ ID NO: 253 - DNA, 26 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (13)..(13): methylated C nucleotide
  modified_base (18)..(18): methylated C nucleotide
ggcgcgcggggccgggccggggaggg

SEQ ID NO: 254 - DNA, 23 bp, Artificial Sequence
  Synthetic
  modified_base (4)..(4): methylated C nucleotide
  modified_base (6)..(6): methylated C nucleotide
  modified_base (8)..(8): methylated C nucleotide
  modified_base (14)..(14): methylated C nucleotide
  modified_base (19)..(19): methylated C nucleotide
tggcgcgcggggccgggccgggg

SEQ ID NO: 255 - DNA, 25 bp, Artificial Sequence
  Synthetic
  modified_base (5)..(5): methylated C nucleotide
  modified_base (7)..(7): methylated C nucleotide
  modified_base (9)..(9): methylated C nucleotide
  modified_base (15)..(15): methylated C nucleotide
  modified_base (20)..(20): methylated C nucleotide
atggcgcgcggggccgggccgggga

SEQ ID NO: 256 - DNA, 27 bp, Artificial Sequence
  Synthetic
  modified_base (6)..(6): methylated C nucleotide
  modified_base (8)..(8): methylated C nucleotide
  modified_base (10)..(10): methylated C nucleotide
  modified_base (16)..(16): methylated C nucleotide
  modified_base (21)..(21): methylated C nucleotide
catggcgcgcggggccgggccggggag

SEQ ID NO: 257 - DNA, 29 bp, Artificial Sequence
  Synthetic
  modified_base (7)..(7): methylated C nucleotide
  modified_base (9)..(9): methylated C nucleotide
  modified_base (11)..(11): methylated C nucleotide
  modified_base (17)..(17): methylated C nucleotide
  modified_base (22)..(22): methylated C nucleotide
acatggcgcgcggggccgggccggggagg

SEQ ID NO: 258 - DNA, 31 bp, Artificial Sequence
  Synthetic
  modified_base (8)..(8): methylated C nucleotide
  modified_base (10)..(10): methylated C nucleotide
  modified_base (12)..(12): methylated C nucleotide
  modified_base (18)..(18): methylated C nucleotide
  modified_base (23)..(23): methylated C nucleotide
cacatggcgcgcggggccgggccggggaggg

SEQ ID NO: 259 - DNA, 21 bp, Artificial Sequence
  Synthetic
  modified_base (6)..(6): methylated C nucleotide
  modified_base (8)..(8): methylated C nucleotide
  modified_base (10)..(10): methylated C nucleotide
  modified_base (16)..(16): methylated C nucleotide
  modified_base (21)..(21): methylated C nucleotide
catggcgcgcggggccgggcc

SEQ ID NO: 260 - DNA, 21 bp, Artificial Sequence
  Synthetic
  modified_base (9)..(9): methylated C nucleotide
  modified_base (11)..(11): methylated C nucleotide
  modified_base (13)..(13): methylated C nucleotide
  modified_base (19)..(19): methylated C nucleotide
gcacatggcgcgcggggccgg

SEQ ID NO: 261 - DNA, 21 bp, Artificial Sequence
  Synthetic
  modified_base (12)..(12): methylated C nucleotide
  modified_base (14)..(14): methylated C nucleotide
  modified_base (16)..(16): methylated C nucleotide
ggggcacatggcgcgcggggc

SEQ ID NO: 262 - DNA, 21 bp, Artificial Sequence
  Synthetic
  modified_base (15)..(15): methylated C nucleotide
  modified_base (17)..(17): methylated C nucleotide
  modified_base (19)..(19): methylated C nucleotide
ccgggggcacatggcgcgcgg

SEQ ID NO: 263 - DNA, 21 bp, Artificial Sequence
  Synthetic
  modified_base (18)..(18): methylated C nucleotide
  modified_base (20)..(20): methylated C nucleotide
ggcccgggggcacatggcgcg

SEQ ID NO: 264 - DNA, 21 bp, Artificial Sequence
  Synthetic
  modified_base (2)..(2): methylated C nucleotide
  modified_base (4)..(4): methylated C nucleotide
  modified_base (10)..(10): methylated C nucleotide
  modified_base (15)..(15): methylated C nucleotide
gcgcggggccgggccggggag

SEQ ID NO: 265 - DNA, 21 bp, Artificial Sequence
  Synthetic
  modified_base (1)..(1): methylated C nucleotide
  modified_base (7)..(7): methylated C nucleotide
  modified_base (12)..(12): methylated C nucleotide
cggggccgggccggggagggc

SEQ ID NO: 266 - DNA, 21 bp, Artificial Sequence
  Synthetic
  modified_base (4)..(4): methylated C nucleotide
  modified_base (9)..(9): methylated C nucleotide
ggccgggccggggagggcgcc

SEQ ID NO: 267 - DNA, 21 bp, Artificial Sequence
  Synthetic
  modified_base (1)..(1): methylated C nucleotide
  modified_base (6)..(6): methylated C nucleotide
cgggccggggagggcgcctcc

SEQ ID NO: 268 - DNA, 21 bp, Artificial Sequence
  Synthetic
  modified_base (3)..(3): methylated C nucleotide
gccggggagggcgcctccggg

SEQ ID NO: 269 - DNA, 19 bp, Artificial Sequence
  Synthetic
  modified_base (1)..(1): methylated C nucleotide
  modified_base (3)..(3): methylated C nucleotide
  modified_base (5)..(5): methylated C nucleotide
  modified_base (11)..(11): methylated C nucleotide
  modified_base (16)..(16): methylated C nucleotide
cgcgcggggccgggccggg

SEQ ID NO: 270 - DNA, 17 bp, Artificial Sequence
  Synthetic
  modified_base (1)..(1): methylated C nucleotide
  modified_base (3)..(3): methylated C nucleotide
  modified_base (9)..(9): methylated C nucleotide
  modified_base (14)..(14): methylated C nucleotide
cgcggggccgggccggg

SEQ ID NO: 271 - DNA, 15 bp, Artificial Sequence
  Synthetic
  modified_base (1)..(1): methylated C nucleotide
  modified_base (7)..(7): methylated C nucleotide
  modified_base (12)..(12): methylated C nucleotide
cggggccgggccggg

SEQ ID NO: 272 - DNA, 19 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (13)..(13): methylated C nucleotide
  modified_base (18)..(18): methylated C nucleotide
ggcgcgcggggccgggccg

SEQ ID NO: 273 - DNA, 17 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (13)..(13): methylated C nucleotide
ggcgcgcggggccgggc

SEQ ID NO: 274 - DNA, 15 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (13)..(13): methylated C nucleotide
ggcgcgcggggccgg

SEQ ID NO: 275 - DNA, 21 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (13)..(13): methylated C nucleotide
  modified_base (18)..(18): methylated C nucleotide
ggcgcacggggccgggccggg

SEQ ID NO: 276 - DNA, 21 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (13)..(13): methylated C nucleotide
  modified_base (18)..(18): methylated C nucleotide
ggcgcgcggggccggtccggg

SEQ ID NO: 277 - DNA, 21 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (13)..(13): methylated C nucleotide
  modified_base (18)..(18): methylated C nucleotide
ggcgcgccgggccgggccggg

SEQ ID NO: 278 - DNA, 27 bp, Artificial Sequence
  Synthetic
  modified_base (7)..(7): methylated C nucleotide
  modified_base (9)..(9): methylated C nucleotide
  modified_base (11)..(11): methylated C nucleotide
  modified_base (17)..(17): methylated C nucleotide
  modified_base (22)..(22): methylated C nucleotide
acatggcgcgcggggccgggccgggga

SEQ ID NO: 279 - DNA, 28 bp, Artificial Sequence
  Synthetic
  modified_base (8)..(8): methylated C nucleotide
  modified_base (10)..(10): methylated C nucleotide
  modified_base (12)..(12): methylated C nucleotide
  modified_base (18)..(18): methylated C nucleotide
  modified_base (23)..(23): methylated C nucleotide
cacatggcgcgcggggccgggccgggga

SEQ ID NO: 280 - DNA, 29 bp, Artificial Sequence
  Synthetic
  modified_base (9)..(9): methylated C nucleotide
  modified_base (11)..(11): methylated C nucleotide
  modified_base (13)..(13): methylated C nucleotide
  modified_base (19)..(19): methylated C nucleotide
  modified_base (24)..(24): methylated C nucleotide
gcacatggcgcgcggggccgggccgggga

SEQ ID NO: 281 - DNA, 30 bp, Artificial Sequence
  Synthetic
  modified_base (10)..(10): methylated C nucleotide
  modified_base (12)..(12): methylated C nucleotide
  modified_base (14)..(14): methylated C nucleotide
  modified_base (20)..(20): methylated C nucleotide
  modified_base (25)..(25): methylated C nucleotide
ggcacatggcgcgcggggccgggccgggga

SEQ ID NO: 282 - DNA, 31 bp, Artificial Sequence
  Synthetic
  modified_base (11)..(11): methylated C nucleotide
  modified_base (13)..(13): methylated C nucleotide
  modified_base (15)..(15): methylated C nucleotide
  modified_base (21)..(21): methylated C nucleotide
  modified_base (26)..(26): methylated C nucleotide
gggcacatggcgcgcggggccgggccgggga

SEQ ID NO: 283 - DNA, 32 bp, Artificial Sequence
  Synthetic
  modified_base (12)..(12): methylated C nucleotide
  modified_base (14)..(14): methylated C nucleotide
  modified_base (16)..(16): methylated C nucleotide
  modified_base (22)..(22): methylated C nucleotide
  modified_base (27)..(27): methylated C nucleotide
ggggcacatggcgcgcggggccgggccgggga

SEQ ID NO: 284 - DNA, 28 bp, Artificial Sequence
  Synthetic
  modified_base (7)..(7): methylated C nucleotide
  modified_base (9)..(9): methylated C nucleotide
  modified_base (11)..(11): methylated C nucleotide
  modified_base (17)..(17): methylated C nucleotide
  modified_base (22)..(22): methylated C nucleotide
acatggcgcgcggggccgggccggggag

SEQ ID NO: 285 - DNA, 29 bp, Artificial Sequence
  Synthetic
  modified_base (7)..(7): methylated C nucleotide
  modified_base (9)..(9): methylated C nucleotide
  modified_base (11)..(11): methylated C nucleotide
  modified_base (17)..(17): methylated C nucleotide
  modified_base (22)..(22): methylated C nucleotide
acatggcgcgcggggccgggccggggagg

SEQ ID NO: 286 - DNA, 30 bp, Artificial Sequence
  Synthetic
  modified_base (7)..(7): methylated C nucleotide
  modified_base (9)..(9): methylated C nucleotide
  modified_base (11)..(11): methylated C nucleotide
  modified_base (17)..(17): methylated C nucleotide
  modified_base (22)..(22): methylated C nucleotide
acatggcgcgcggggccgggccggggaggg

SEQ ID NO: 287 - DNA, 31 bp, Artificial Sequence
  Synthetic
  modified_base (7)..(7): methylated C nucleotide
  modified_base (9)..(9): methylated C nucleotide
  modified_base (11)..(11): methylated C nucleotide
  modified_base (17)..(17): methylated C nucleotide
  modified_base (22)..(22): methylated C nucleotide
acatggcgcgcggggccgggccggggagggc

SEQ ID NO: 288 - DNA, 32 bp, Artificial Sequence
  Synthetic
  modified_base (7)..(7): methylated C nucleotide
  modified_base (9)..(9): methylated C nucleotide
  modified_base (11)..(11): methylated C nucleotide
  modified_base (17)..(17): methylated C nucleotide
  modified_base (22)..(22): methylated C nucleotide
acatggcgcgcggggccgggccggggagggcg

SEQ ID NO: 289 - DNA, 29 bp, Artificial Sequence
  Synthetic
  modified_base (8)..(8): methylated C nucleotide
  modified_base (10)..(10): methylated C nucleotide
  modified_base (12)..(12): methylated C nucleotide
  modified_base (18)..(18): methylated C nucleotide
  modified_base (23)..(23): methylated C nucleotide
cacatggcgcgcggggccgggccggggag

SEQ ID NO: 290 - DNA, 31 bp, Artificial Sequence
  Synthetic
  modified_base (9)..(9): methylated C nucleotide
  modified_base (11)..(11): methylated C nucleotide
  modified_base (13)..(13): methylated C nucleotide
  modified_base (19)..(19): methylated C nucleotide
  modified_base (24)..(24): methylated C nucleotide
gcacatggcgcgcggggccgggccggggagg

SEQ ID NO: 291 - DNA, 33 bp, Artificial Sequence
  Synthetic
  modified_base (10)..(10): methylated C nucleotide
  modified_base (12)..(12): methylated C nucleotide
  modified_base (14)..(14): methylated C nucleotide
  modified_base (20)..(20): methylated C nucleotide
  modified_base (25)..(25): methylated C nucleotide
ggcacatggcgcgcggggccgggccggggaggg

SEQ ID NO: 292 - DNA, 35 bp, Artificial Sequence
  Synthetic
  modified_base (11)..(11): methylated C nucleotide
  modified_base (13)..(13): methylated C nucleotide
  modified_base (15)..(15): methylated C nucleotide
  modified_base (21)..(21): methylated C nucleotide
  modified_base (26)..(26): methylated C nucleotide
gggcacatggcgcgcggggccgggccggggagggc

SEQ ID NO: 293 - DNA, 37 bp, Artificial Sequence
  Synthetic
  modified_base (12)..(12): methylated C nucleotide
  modified_base (14)..(14): methylated C nucleotide
  modified_base (16)..(16): methylated C nucleotide
  modified_base (22)..(22): methylated C nucleotide
  modified_base (27)..(27): methylated C nucleotide
ggggcacatggcgcgcggggccgggccggggagggcg

SEQ ID NO: 294 - DNA, 27 bp, Artificial Sequence
  Synthetic
  modified_base (10)..(10): methylated C nucleotide
  modified_base (12)..(12): methylated C nucleotide
  modified_base (14)..(14): methylated C nucleotide
  modified_base (20)..(20): methylated C nucleotide
  modified_base (25)..(25): methylated C nucleotide
ggcacatggcgcgcggggccgggccgg

SEQ ID NO: 295 - DNA, 27 bp, Artificial Sequence
  Synthetic
  modified_base (13)..(13): methylated C nucleotide
  modified_base (15)..(15): methylated C nucleotide
  modified_base (17)..(17): methylated C nucleotide
  modified_base (23)..(23): methylated C nucleotide
gggggcacatggcgcgcggggccgggc

SEQ ID NO: 296 - DNA, 27 bp, Artificial Sequence
  Synthetic
  modified_base (16)..(16): methylated C nucleotide
  modified_base (18)..(18): methylated C nucleotide
  modified_base (20)..(20): methylated C nucleotide
  modified_base (26)..(26): methylated C nucleotide
gccgggggcacatggcgcgcggggccg

SEQ ID NO: 297 - DNA, 27 bp, Artificial Sequence
  Synthetic
  modified_base (19)..(19): methylated C nucleotide
  modified_base (21)..(21): methylated C nucleotide
  modified_base (23)..(23): methylated C nucleotide
cccgccgggggcacatggcgcgcgggg

SEQ ID NO: 298 - DNA, 27 bp, Artificial Sequence
  Synthetic
  modified_base (22)..(22): methylated C nucleotide
  modified_base (24)..(24): methylated C nucleotide
  modified_base (26)..(26): methylated C nucleotide
cgtcccgccgggggcacatggcgcgcg

SEQ ID NO: 299 - DNA, 27 bp, Artificial Sequence
  Synthetic
  modified_base (4)..(4): methylated C nucleotide
  modified_base (6)..(6): methylated C nucleotide
  modified_base (8)..(8): methylated C nucleotide
  modified_base (14)..(14): methylated C nucleotide
  modified_base (19)..(19): methylated C nucleotide
tggcgcgcggggccgggccggggaggg

SEQ ID NO: 300 - DNA, 27 bp, Artificial Sequence
  Synthetic
  modified_base (1)..(1): methylated C nucleotide
  modified_base (3)..(3): methylated C nucleotide
  modified_base (5)..(5): methylated C nucleotide
  modified_base (11)..(11): methylated C nucleotide
  modified_base (16)..(16): methylated C nucleotide
cgcgcggggccgggccggggagggcgc

SEQ ID NO: 301 - DNA, 27 bp, Artificial Sequence
  Synthetic
  modified_base (2)..(2): methylated C nucleotide
  modified_base (8)..(8): methylated C nucleotide
  modified_base (13)..(13): methylated C nucleotide
gcggggccgggccggggagggcgcctc

SEQ ID NO: 302 - DNA, 27 bp, Artificial Sequence
  Synthetic
  modified_base (5)..(5): methylated C nucleotide
  modified_base (10)..(10): methylated C nucleotide
gggccgggccggggagggcgcctccgg

SEQ ID NO: 303 - DNA, 27 bp, Artificial Sequence
  Synthetic
  modified_base (2)..(2): methylated C nucleotide
  modified_base (7)..(7): methylated C nucleotide
ccgggccggggagggcgcctccgggcc

SEQ ID NO: 304 - DNA, 25 bp, Artificial Sequence
  Synthetic
  modified_base (5)..(5): methylated C nucleotide
  modified_base (7)..(7): methylated C nucleotide
  modified_base (9)..(9): methylated C nucleotide
  modified_base (15)..(15): methylated C nucleotide
  modified_base (20)..(20): methylated C nucleotide
atggcgcgcggggccgggccgggga

SEQ ID NO: 305 - DNA, 23 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (13)..(13): methylated C nucleotide
  modified_base (18)..(18): methylated C nucleotide
ggcgcgcggggccgggccgggga

SEQ ID NO: 306 - DNA, 21 bp, Artificial Sequence
  Synthetic
  modified_base (1)..(1): methylated C nucleotide
  modified_base (3)..(3): methylated C nucleotide
  modified_base (5)..(5): methylated C nucleotide
  modified_base (11)..(11): methylated C nucleotide
  modified_base (16)..(16): methylated C nucleotide
cgcgcggggccgggccgggga

SEQ ID NO: 307 - DNA, 19 bp, Artificial Sequence
  Synthetic
  modified_base (1)..(1): methylated C nucleotide
  modified_base (3)..(3): methylated C nucleotide
  modified_base (9)..(9): methylated C nucleotide
  modified_base (14)..(14): methylated C nucleotide
cgcggggccgggccgggga

SEQ ID NO: 308 - DNA, 17 bp, Artificial Sequence
  Synthetic
  modified_base (1)..(1): methylated C nucleotide
  modified_base (7)..(7): methylated C nucleotide
  modified_base (12)..(12): methylated C nucleotide
cggggccgggccgggga

SEQ ID NO: 309 - DNA, 15 bp, Artificial Sequence
  Synthetic
  modified_base (5)..(5): methylated C nucleotide
  modified_base (10)..(10): methylated C nucleotide
gggccgggccgggga

SEQ ID NO: 310 - DNA, 25 bp, Artificial Sequence
  Synthetic
  modified_base (7)..(7): methylated C nucleotide
  modified_base (9)..(9): methylated C nucleotide
  modified_base (11)..(11): methylated C nucleotide
  modified_base (17)..(17): methylated C nucleotide
  modified_base (22)..(22): methylated C nucleotide
acatggcgcgcggggccgggccggg

SEQ ID NO: 311 - DNA, 23 bp, Artificial Sequence
  Synthetic
  modified_base (7)..(7): methylated C nucleotide
  modified_base (9)..(9): methylated C nucleotide
  modified_base (11)..(11): methylated C nucleotide
  modified_base (17)..(17): methylated C nucleotide
  modified_base (22)..(22): methylated C nucleotide
acatggcgcgcggggccgggccg

SEQ ID NO: 312 - DNA, 21 bp, Artificial Sequence
  Synthetic
  modified_base (7)..(7): methylated C nucleotide
  modified_base (9)..(9): methylated C nucleotide
  modified_base (11)..(11): methylated C nucleotide
  modified_base (17)..(17): methylated C nucleotide
acatggcgcgcggggccgggc

SEQ ID NO: 313 - DNA, 19 bp, Artificial Sequence
  Synthetic
  modified_base (7)..(7): methylated C nucleotide
  modified_base (9)..(9): methylated C nucleotide
  modified_base (11)..(11): methylated C nucleotide
  modified_base (17)..(17): methylated C nucleotide
acatggcgcgcggggccgg

SEQ ID NO: 314 - DNA, 17 bp, Artificial Sequence
  Synthetic
  modified_base (7)..(7): methylated C nucleotide
  modified_base (9)..(9): methylated C nucleotide
  modified_base (11)..(11): methylated C nucleotide
  modified_base (17)..(17): methylated C nucleotide
acatggcgcgcggggcc

SEQ ID NO: 315 - DNA, 15 bp, Artificial Sequence
  Synthetic
  modified_base (7)..(7): methylated C nucleotide
  modified_base (9)..(9): methylated C nucleotide
  modified_base (11)..(11): methylated C nucleotide
acatggcgcgcgggg

SEQ ID NO: 316 - DNA, 27 bp, Artificial Sequence
  Synthetic
  modified_base (7)..(7): methylated C nucleotide
  modified_base (9)..(9): methylated C nucleotide
  modified_base (11)..(11): methylated C nucleotide
  modified_base (17)..(17): methylated C nucleotide
  modified_base (22)..(22): methylated C nucleotide
acatggctcgcggggccgggccgggga

SEQ ID NO: 317 - DNA, 27 bp, Artificial Sequence
  Synthetic
  modified_base (7)..(7): methylated C nucleotide
  modified_base (9)..(9): methylated C nucleotide
  modified_base (11)..(11): methylated C nucleotide
  modified_base (17)..(17): methylated C nucleotide
  modified_base (22)..(22): methylated C nucleotide
acatggcgcgcggggccggcccgggga

SEQ ID NO: 318 - DNA, 27 bp, Artificial Sequence
  Synthetic
  modified_base (7)..(7): methylated C nucleotide
  modified_base (9)..(9): methylated C nucleotide
  modified_base (11)..(11): methylated C nucleotide
  modified_base (17)..(17): methylated C nucleotide
  modified_base (22)..(22): methylated C nucleotide
acatggcgcacggggccgggccgggga

SEQ ID NO: 319 - DNA, 26 bp, Artificial Sequence
  Synthetic
  modified_base (3)..(3): methylated C nucleotide
  modified_base (19)..(19): methylated C nucleotide
  modified_base (21)..(21): methylated C nucleotide
  modified_base (23)..(23): methylated C nucleotide
gccgcattgaattaactacgcgcgcc

SEQ ID NO: 320 - DNA, 27 bp, Artificial Sequence
  Synthetic
  modified_base (4)..(4): methylated C nucleotide
  modified_base (20)..(20): methylated C nucleotide
  modified_base (22)..(22): methylated C nucleotide
  modified_base (24)..(24): methylated C nucleotide
agccgcattgaattaactacgcgcgcc

SEQ ID NO: 321 - DNA, 28 bp, Artificial Sequence
  Synthetic
  modified_base (5)..(5): methylated C nucleotide
  modified_base (21)..(21): methylated C nucleotide
  modified_base (23)..(23): methylated C nucleotide
  modified_base (25)..(25): methylated C nucleotide
gagccgcattgaattaactacgcgcgcc

SEQ ID NO: 322 - DNA, 29 bp, Artificial Sequence
  Synthetic
  modified_base (6)..(6): methylated C nucleotide
  modified_base (22)..(22): methylated C nucleotide
  modified_base (24)..(24): methylated C nucleotide
  modified_base (26)..(26): methylated C nucleotide
agagccgcattgaattaactacgcgcgcc

SEQ ID NO: 323 - DNA, 30 bp, Artificial Sequence
  Synthetic
  modified_base (7)..(7): methylated C nucleotide
  modified_base (23)..(23): methylated C nucleotide
  modified_base (25)..(25): methylated C nucleotide
  modified_base (27)..(27): methylated C nucleotide
gagagccgcattgaattaactacgcgcgcc

SEQ ID NO: 324 - DNA, 31 bp, Artificial Sequence
  Synthetic
  modified_base (8)..(8): methylated C nucleotide
  modified_base (24)..(24): methylated C nucleotide
  modified_base (26)..(26): methylated C nucleotide
  modified_base (28)..(28): methylated C nucleotide
agagagccgcattgaattaactacgcgcgcc

SEQ ID NO: 325 - DNA, 27 bp, Artificial Sequence
  Synthetic
  modified_base (3)..(3): methylated C nucleotide
  modified_base (19)..(19): methylated C nucleotide
  modified_base (21)..(21): methylated C nucleotide
  modified_base (23)..(23): methylated C nucleotide
gccgcattgaattaactacgcgcgcct

SEQ ID NO: 326 - DNA, 28 bp, Artificial Sequence
  Synthetic
  modified_base (3)..(3): methylated C nucleotide
  modified_base (19)..(19): methylated C nucleotide
  modified_base (21)..(21): methylated C nucleotide
  modified_base (23)..(23): methylated C nucleotide
gccgcattgaattaactacgcgcgccta

SEQ ID NO: 327 - DNA, 29 bp, Artificial Sequence
  Synthetic
  modified_base (3)..(3): methylated C nucleotide
  modified_base (19)..(19): methylated C nucleotide
  modified_base (21)..(21): methylated C nucleotide
  modified_base (23)..(23): methylated C nucleotide
gccgcattgaattaactacgcgcgcctac

SEQ ID NO: 328 - DNA, 30 bp, Artificial Sequence
  Synthetic
  modified_base (3)..(3): methylated C nucleotide
  modified_base (19)..(19): methylated C nucleotide
  modified_base (21)..(21): methylated C nucleotide
  modified_base (23)..(23): methylated C nucleotide
gccgcattgaattaactacgcgcgcctacc

SEQ ID NO: 329 - DNA, 31 bp, Artificial Sequence
  Synthetic
  modified_base (3)..(3): methylated C nucleotide
  modified_base (19)..(19): methylated C nucleotide
  modified_base (21)..(21): methylated C nucleotide
  modified_base (23)..(23): methylated C nucleotide
gccgcattgaattaactacgcgcgcctacca

SEQ ID NO: 330 - DNA, 28 bp, Artificial Sequence
  Synthetic
  modified_base (4)..(4): methylated C nucleotide
  modified_base (20)..(20): methylated C nucleotide
  modified_base (22)..(22): methylated C nucleotide
  modified_base (24)..(24): methylated C nucleotide
agccgcattgaattaactacgcgcgcct

SEQ ID NO: 331 - DNA, 30 bp, Artificial Sequence
  Synthetic
  modified_base (5)..(5): methylated C nucleotide
  modified_base (21)..(21): methylated C nucleotide
  modified_base (23)..(23): methylated C nucleotide
  modified_base (25)..(25): methylated C nucleotide
gagccgcattgaattaactacgcgcgccta

SEQ ID NO: 332 - DNA, 32 bp, Artificial Sequence
  Synthetic
  modified_base (6)..(6): methylated C nucleotide
  modified_base (22)..(22): methylated C nucleotide
  modified_base (24)..(24): methylated C nucleotide
  modified_base (26)..(26): methylated C nucleotide
agagccgcattgaattaactacgcgcgcctac

SEQ ID NO: 333 - DNA, 34 bp, Artificial Sequence
  Synthetic
  modified_base (7)..(7): methylated C nucleotide
  modified_base (23)..(23): methylated C nucleotide
  modified_base (25)..(25): methylated C nucleotide
  modified_base (27)..(27): methylated C nucleotide
gagagccgcattgaattaactacgcgcgcctacc

SEQ ID NO: 334 - DNA, 36 bp, Artificial Sequence
  Synthetic
  modified_base (8)..(8): methylated C nucleotide
  modified_base (24)..(24): methylated C nucleotide
  modified_base (26)..(26): methylated C nucleotide
  modified_base (28)..(28): methylated C nucleotide
agagagccgcattgaattaactacgcgcgcctacca

SEQ ID NO: 335 - DNA, 26 bp, Artificial Sequence
  Synthetic
  modified_base (6)..(6): methylated C nucleotide
  modified_base (22)..(22): methylated C nucleotide
  modified_base (24)..(24): methylated C nucleotide
  modified_base (26)..(26): methylated C nucleotide
agagccgcattgaattaactacgcgc

SEQ ID NO: 336 - DNA, 26 bp, Artificial Sequence
  Synthetic
  modified_base (9)..(9): methylated C nucleotide
  modified_base (25)..(25): methylated C nucleotide
aagagagccgcattgaattaactacg

SEQ ID NO: 337 - DNA, 26 bp, Artificial Sequence
  Synthetic
  modified_base (12)..(12): methylated C nucleotide
agtaagagagccgcattgaattaact

SEQ ID NO: 338 - DNA, 26 bp, Artificial Sequence
  Synthetic
  modified_base (15)..(15): methylated C nucleotide
cagagtaagagagccgcattgaatta

SEQ ID NO: 339 - DNA, 26 bp, Artificial Sequence
  Synthetic
  modified_base (18)..(18): methylated C nucleotide
aaacagagtaagagagccgcattgaa

SEQ ID NO: 340 - DNA, 26 bp, Artificial Sequence
  Synthetic
  modified_base (16)..(16): methylated C nucleotide
  modified_base (18)..(18): methylated C nucleotide
  modified_base (20)..(20): methylated C nucleotide
gcattgaattaactacgcgcgcctac

SEQ ID NO: 341 - DNA, 26 bp, Artificial Sequence
  Synthetic
  modified_base (13)..(13): methylated C nucleotide
  modified_base (15)..(15): methylated C nucleotide
  modified_base (17)..(17): methylated C nucleotide
ttgaattaactacgcgcgcctaccat

SEQ ID NO: 342 - DNA, 26 bp, Artificial Sequence
  Synthetic
  modified_base (10)..(10): methylated C nucleotide
  modified_base (12)..(12): methylated C nucleotide
  modified_base (14)..(14): methylated C nucleotide
aattaactacgcgcgcctaccatttt

SEQ ID NO: 343 - DNA, 26 bp, Artificial Sequence
  Synthetic
  modified_base (7)..(7): methylated C nucleotide
  modified_base (9)..(9): methylated C nucleotide
  modified_base (11)..(11): methylated C nucleotide
taactacgcgcgcctaccattttctt

SEQ ID NO: 344 - DNA, 26 bp, Artificial Sequence
  Synthetic
  modified_base (4)..(4): methylated C nucleotide
  modified_base (6)..(6): methylated C nucleotide
  modified_base (8)..(8): methylated C nucleotide
ctacgcgcgcctaccattttcttttg

SEQ ID NO: 345 - DNA, 24 bp, Artificial Sequence
  Synthetic
  modified_base (1)..(1): methylated C nucleotide
  modified_base (17)..(17): methylated C nucleotide
  modified_base (19)..(19): methylated C nucleotide
  modified_base (21)..(21): methylated C nucleotide
cgcattgaattaactacgcgcgcc

SEQ ID NO: 346 - DNA, 22 bp, Artificial Sequence
  Synthetic
  modified_base (15)..(15): methylated C nucleotide
  modified_base (17)..(17): methylated C nucleotide
  modified_base (19)..(19): methylated C nucleotide
cattgaattaactacgcgcgcc

SEQ ID NO: 347 - DNA, 20 bp, Artificial Sequence
  Synthetic
  modified_base (13)..(13): methylated C nucleotide
  modified_base (15)..(15): methylated C nucleotide
  modified_base (17)..(17): methylated C nucleotide
ttgaattaactacgcgcgcc

SEQ ID NO: 348 - DNA, 18 bp, Artificial Sequence
  Synthetic
  modified_base (11)..(11): methylated C nucleotide
  modified_base (13)..(13): methylated C nucleotide
  modified_base (15)..(15): methylated C nucleotide
gaattaactacgcgcgcc

SEQ ID NO: 349 - DNA, 16 bp, Artificial Sequence
  Synthetic
  modified_base (9)..(9): methylated C nucleotide
  modified_base (11)..(11): methylated C nucleotide
  modified_base (13)..(13): methylated C nucleotide
attaactacgcgcgcc

SEQ ID NO: 350 - DNA, 15 bp, Artificial Sequence
  Synthetic
  modified_base (8)..(8): methylated C nucleotide
  modified_base (10)..(10): methylated C nucleotide
  modified_base (12)..(12): methylated C nucleotide
ttaactacgcgcgcc

SEQ ID NO: 351 - DNA, 24 bp, Artificial Sequence
  Synthetic
  modified_base (3)..(3): methylated C nucleotide
  modified_base (19)..(19): methylated C nucleotide
  modified_base (21)..(21): methylated C nucleotide
  modified_base (23)..(23): methylated C nucleotide
gccgcattgaattaactacgcgcg

SEQ ID NO: 352 - DNA, 22 bp, Artificial Sequence
  Synthetic
  modified_base (3)..(3): methylated C nucleotide
  modified_base (19)..(19): methylated C nucleotide
  modified_base (21)..(21): methylated C nucleotide
gccgcattgaattaactacgcg

SEQ ID NO: 353 - DNA, 20 bp, Artificial Sequence
  Synthetic
  modified_base (3)..(3): methylated C nucleotide
  modified_base (19)..(19): methylated C nucleotide
gccgcattgaattaactacg

SEQ ID NO: 354 - DNA, 18 bp, Artificial Sequence
  Synthetic
  modified_base (3)..(3): methylated C nucleotide
gccgcattgaattaacta

SEQ ID NO: 355 - DNA, 16 bp, Artificial Sequence
  Synthetic
  modified_base (3)..(3): methylated C nucleotide
gccgcattgaattaac

SEQ ID NO: 356 - DNA, 15 bp, Artificial Sequence
  Synthetic
  modified_base (3)..(3): methylated C nucleotide
gccgcattgaattaa

SEQ ID NO: 357 - DNA, 26 bp, Artificial Sequence
  Synthetic
  modified_base (3)..(3): methylated C nucleotide
  modified_base (19)..(19): methylated C nucleotide
  modified_base (21)..(21): methylated C nucleotide
  modified_base (23)..(23): methylated C nucleotide
gccgcattgaattcactacgcgcgcc

SEQ ID NO: 358 - DNA, 26 bp, Artificial Sequence
  Synthetic
  modified_base (3)..(3): methylated C nucleotide
  modified_base (19)..(19): methylated C nucleotide
  modified_base (21)..(21): methylated C nucleotide
  modified_base (23)..(23): methylated C nucleotide
gccgcatcgaattaactacgcgcgcc

SEQ ID NO: 359 - DNA, 26 bp, Artificial Sequence
  Synthetic
  modified_base (3)..(3): methylated C nucleotide
  modified_base (19)..(19): methylated C nucleotide
  modified_base (21)..(21): methylated C nucleotide
  modified_base (23)..(23): methylated C nucleotide
gccgcattgagttaactacgcgcgcc

SEQ ID NO: 360 - DNA, 24 bp, Artificial Sequence
  Synthetic
  modified_base (3)..(3): methylated C nucleotide
  modified_base (10)..(10): methylated C nucleotide
  modified_base (21)..(21): methylated C nucleotide
gccggtgggcggagagttagcgag

SEQ ID NO: 361 - DNA, 25 bp, Artificial Sequence
  Synthetic
  modified_base (4)..(4): methylated C nucleotide
  modified_base (11)..(11): methylated C nucleotide
  modified_base (22)..(22): methylated C nucleotide
ggccggtgggcggagagttagcgag

SEQ ID NO: 362 - DNA, 26 bp, Artificial Sequence
  Synthetic
  modified_base (5)..(5): methylated C nucleotide
  modified_base (12)..(12): methylated C nucleotide
  modified_base (23)..(23): methylated C nucleotide
gggccggtgggcggagagttagcgag

SEQ ID NO: 363 - DNA, 27 bp, Artificial Sequence
  Synthetic
  modified_base (6)..(6): methylated C nucleotide
  modified_base (13)..(13): methylated C nucleotide
  modified_base (24)..(24): methylated C nucleotide
agggccggtgggcggagagttagcgag

SEQ ID NO: 364 - DNA, 28 bp, Artificial Sequence
  Synthetic
  modified_base (7)..(7): methylated C nucleotide
  modified_base (14)..(14): methylated C nucleotide
  modified_base (25)..(25): methylated C nucleotide
aagggccggtgggcggagagttagcgag

SEQ ID NO: 365 - DNA, 29 bp, Artificial Sequence
  Synthetic
  modified_base (8)..(8): methylated C nucleotide
  modified_base (15)..(15): methylated C nucleotide
  modified_base (26)..(26): methylated C nucleotide
aaagggccggtgggcggagagttagcgag

SEQ ID NO: 366 - DNA, 25 bp, Artificial Sequence
  Synthetic
  modified_base (3)..(3): methylated C nucleotide
  modified_base (10)..(10): methylated C nucleotide
  modified_base (21)..(21): methylated C nucleotide
gccggtgggcggagagttagcgaga

SEQ ID NO: 367 - DNA, 26 bp, Artificial Sequence
  Synthetic
  modified_base (3)..(3): methylated C nucleotide
  modified_base (10)..(10): methylated C nucleotide
  modified_base (21)..(21): methylated C nucleotide
gccggtgggcggagagttagcgagag

SEQ ID NO: 368 - DNA, 27 bp, Artificial Sequence
  Synthetic
  modified_base (3)..(3): methylated C nucleotide
  modified_base (10)..(10): methylated C nucleotide
  modified_base (21)..(21): methylated C nucleotide
gccggtgggcggagagttagcgagaga

SEQ ID NO: 369 - DNA, 28 bp, Artificial Sequence
  Synthetic
  modified_base (3)..(3): methylated C nucleotide
  modified_base (10)..(10): methylated C nucleotide
  modified_base (21)..(21): methylated C nucleotide
gccggtgggcggagagttagcgagagag

SEQ ID NO: 370 - DNA, 29 bp, Artificial Sequence
  Synthetic
  modified_base (3)..(3): methylated C nucleotide
  modified_base (10)..(10): methylated C nucleotide
  modified_base (21)..(21): methylated C nucleotide
gccggtgggcggagagttagcgagagagg

SEQ ID NO: 371 - DNA, 26 bp, Artificial Sequence
  Synthetic
  modified_base (4)..(4): methylated C nucleotide
  modified_base (11)..(11): methylated C nucleotide
  modified_base (22)..(22): methylated C nucleotide
ggccggtgggcggagagttagcgaga

SEQ ID NO: 372 - DNA, 28 bp, Artificial Sequence
  Synthetic
  modified_base (5)..(5): methylated C nucleotide
  modified_base (12)..(12): methylated C nucleotide
  modified_base (23)..(23): methylated C nucleotide
gggccggtgggcggagagttagcgagag

SEQ ID NO: 373 - DNA, 30 bp, Artificial Sequence
  Synthetic
  modified_base (6)..(6): methylated C nucleotide
  modified_base (13)..(13): methylated C nucleotide
  modified_base (24)..(24): methylated C nucleotide
agggccggtgggcggagagttagcgagaga

SEQ ID NO: 374 - DNA, 32 bp, Artificial Sequence
  Synthetic
  modified_base (7)..(7): methylated C nucleotide
  modified_base (14)..(14): methylated C nucleotide
  modified_base (25)..(25): methylated C nucleotide
aagggccggtgggcggagagttagcgagagag

SEQ ID NO: 375 - DNA, 34 bp, Artificial Sequence
  Synthetic
  modified_base (8)..(8): methylated C nucleotide
  modified_base (15)..(15): methylated C nucleotide
  modified_base (26)..(26): methylated C nucleotide
aaagggccggtgggcggagagttagcgagagagg

SEQ ID NO: 376 - DNA, 24 bp, Artificial Sequence
  Synthetic
  modified_base (6)..(6): methylated C nucleotide
  modified_base (13)..(13): methylated C nucleotide
  modified_base (24)..(24): methylated C nucleotide
agggccggtgggcggagagttagc

SEQ ID NO: 377 - DNA, 24 bp, Artificial Sequence
  Synthetic
  modified_base (9)..(9): methylated C nucleotide
  modified_base (16)..(16): methylated C nucleotide
taaagggccggtgggcggagagtt

SEQ ID NO: 378 - DNA, 25 bp, Artificial Sequence
  Synthetic
  modified_base (12)..(12): methylated C nucleotide
  modified_base (19)..(19): methylated C nucleotide
ttataaagggccggtgggcggagag

SEQ ID NO: 379 - DNA, 25 bp, Artificial Sequence
  Synthetic
  modified_base (15)..(15): methylated C nucleotide
  modified_base (22)..(22): methylated C nucleotide
gcattataaagggccggtgggcgga

SEQ ID NO: 380 - DNA, 25 bp, Artificial Sequence
  Synthetic
  modified_base (18)..(18): methylated C nucleotide
  modified_base (25)..(25): methylated C nucleotide
ctcgcattataaagggccggtgggc

SEQ ID NO: 381 - DNA, 24 bp, Artificial Sequence
  Synthetic
  modified_base (7)..(7): methylated C nucleotide
  modified_base (18)..(18): methylated C nucleotide
ggtgggcggagagttagcgagaga

SEQ ID NO: 382 - DNA, 24 bp, Artificial Sequence
  Synthetic
  modified_base (4)..(4): methylated C nucleotide
  modified_base (15)..(15): methylated C nucleotide
gggcggagagttagcgagagagga

SEQ ID NO: 383 - DNA, 24 bp, Artificial Sequence
  Synthetic
  modified_base (1)..(1): methylated C nucleotide
  modified_base (12)..(12): methylated C nucleotide
cggagagttagcgagagaggatct

SEQ ID NO: 384 - DNA, 24 bp, Artificial Sequence
  Synthetic
  modified_base (9)..(9): methylated C nucleotide
agagttagcgagagaggatctttt

SEQ ID NO: 385 - DNA, 24 bp, Artificial Sequence
  Synthetic
  modified_base (6)..(6): methylated C nucleotide
gttagcgagagaggatcttttttc

SEQ ID NO: 386 - DNA, 22 bp, Artificial Sequence
  Synthetic
  modified_base (1)..(1): methylated C nucleotide
  modified_base (8)..(8): methylated C nucleotide
  modified_base (19)..(19): methylated C nucleotide
cggtgggcggagagttagcgag

SEQ ID NO: 387 - DNA, 20 bp, Artificial Sequence
  Synthetic
  modified_base (6)..(6): methylated C nucleotide
  modified_base (17)..(17): methylated C nucleotide
gtgggcggagagttagcgag

SEQ ID NO: 388 - DNA, 18 bp, Artificial Sequence
  Synthetic
  modified_base (4)..(4): methylated C nucleotide
  modified_base (15)..(15): methylated C nucleotide
gggcggagagttagcgag

SEQ ID NO: 389 - DNA, 16 bp, Artificial Sequence
  Synthetic
  modified_base (2)..(2): methylated C nucleotide
  modified_base (13)..(13): methylated C nucleotide
gcggagagttagcgag

SEQ ID NO: 390 - DNA, 14 bp, Artificial Sequence
  Synthetic
  modified_base (11)..(11): methylated C nucleotide
ggagagttagcgag

SEQ ID NO: 391 - DNA, 22 bp, Artificial Sequence
  Synthetic
  modified_base (3)..(3): methylated C nucleotide
  modified_base (10)..(10): methylated C nucleotide
  modified_base (21)..(21): methylated C nucleotide
gccggtgggcggagagttagcg

SEQ ID NO: 392 - DNA, 20 bp, Artificial Sequence
  Synthetic
  modified_base (3)..(3): methylated C nucleotide
  modified_base (10)..(10): methylated C nucleotide
gccggtgggcggagagttag

SEQ ID NO: 393 - DNA, 18 bp, Artificial Sequence
  Synthetic
  modified_base (3)..(3): methylated C nucleotide
  modified_base (10)..(10): methylated C nucleotide
gccggtgggcggagagtt

SEQ ID NO: 394 - DNA, 16 bp, Artificial Sequence
  Synthetic
  modified_base (3)..(3): methylated C nucleotide
  modified_base (10)..(10): methylated C nucleotide
gccggtgggcggagag

SEQ ID NO: 395 - DNA, 15 bp, Artificial Sequence
  Synthetic
  modified_base (3)..(3): methylated C nucleotide
  modified_base (10)..(10): methylated C nucleotide
gccggtgggcggaga

SEQ ID NO: 396 - DNA, 24 bp, Artificial Sequence
  Synthetic
  modified_base (3)..(3): methylated C nucleotide
  modified_base (10)..(10): methylated C nucleotide
  modified_base (21)..(21): methylated C nucleotide
gccggtgggcggtgagttagcgag

SEQ ID NO: 397 - DNA, 24 bp, Artificial Sequence
  Synthetic
  modified_base (3)..(3): methylated C nucleotide
  modified_base (10)..(10): methylated C nucleotide
  modified_base (21)..(21): methylated C nucleotide
gccggtcggcggagagttagcgag

SEQ ID NO: 398 - DNA, 24 bp, Artificial Sequence
  Synthetic
  modified_base (3)..(3): methylated C nucleotide
  modified_base (10)..(10): methylated C nucleotide
  modified_base (21)..(21): methylated C nucleotide
gccggtgggcggagagttagctag

SEQ ID NO: 399 - DNA, 28 bp, Artificial Sequence
  Synthetic
  modified_base (3)..(3): methylated C nucleotide
  modified_base (5)..(5): methylated C nucleotide
  modified_base (12)..(12): methylated C nucleotide
  modified_base (17)..(17): methylated C nucleotide
  modified_base (22)..(22): methylated C nucleotide
  modified_base (24)..(24): methylated C nucleotide
  modified_base (26)..(26): methylated C nucleotide
tgcgcgcccaccgccacgccacgcgcgt

SEQ ID NO: 400 - DNA, 29 bp, Artificial Sequence
  Synthetic
  modified_base (4)..(4): methylated C nucleotide
  modified_base (6)..(6): methylated C nucleotide
  modified_base (13)..(13): methylated C nucleotide
  modified_base (18)..(18): methylated C nucleotide
  modified_base (23)..(23): methylated C nucleotide
  modified_base (25)..(25): methylated C nucleotide
  modified_base (27)..(27): methylated C nucleotide
ctgcgcgcccaccgccacgccacgcgcgt

SEQ ID NO: 401 - DNA, 30 bp, Artificial Sequence
  Synthetic
  modified_base (5)..(5): methylated C nucleotide
  modified_base (7)..(7): methylated C nucleotide
  modified_base (14)..(14): methylated C nucleotide
  modified_base (19)..(19): methylated C nucleotide
  modified_base (24)..(24): methylated C nucleotide
  modified_base (26)..(26): methylated C nucleotide
  modified_base (28)..(28): methylated C nucleotide
actgcgcgcccaccgccacgccacgcgcgt

SEQ ID NO: 402 - DNA, 31 bp, Artificial Sequence
  Synthetic
  modified_base (6)..(6): methylated C nucleotide
  modified_base (8)..(8): methylated C nucleotide
  modified_base (15)..(15): methylated C nucleotide
  modified_base (20)..(20): methylated C nucleotide
  modified_base (25)..(25): methylated C nucleotide
  modified_base (27)..(27): methylated C nucleotide
  modified_base (29)..(29): methylated C nucleotide
cactgcgcgcccaccgccacgccacgcgcgt

SEQ ID NO: 403 - DNA, 32 bp, Artificial Sequence
  Synthetic
  modified_base (7)..(7): methylated C nucleotide
  modified_base (9)..(9): methylated C nucleotide
  modified_base (16)..(16): methylated C nucleotide
  modified_base (21)..(21): methylated C nucleotide
  modified_base (26)..(26): methylated C nucleotide
  modified_base (28)..(28): methylated C nucleotide
  modified_base (30)..(30): methylated C nucleotide
ccactgcgcgcccaccgccacgccacgcgcgt

SEQ ID NO: 404 - DNA, 33 bp, Artificial Sequence
  Synthetic
  modified_base (8)..(8): methylated C nucleotide
  modified_base (10)..(10): methylated C nucleotide
  modified_base (17)..(17): methylated C nucleotide
  modified_base (22)..(22): methylated C nucleotide
  modified_base (27)..(27): methylated C nucleotide
  modified_base (29)..(29): methylated C nucleotide
  modified_base (31)..(31): methylated C nucleotide
accactgcgcgcccaccgccacgccacgcgcgt

SEQ ID NO: 405 - DNA, 29 bp, Artificial Sequence
  Synthetic
  modified_base (3)..(3): methylated C nucleotide
  modified_base (5)..(5): methylated C nucleotide
  modified_base (12)..(12): methylated C nucleotide
  modified_base (17)..(17): methylated C nucleotide
  modified_base (22)..(22): methylated C nucleotide
  modified_base (24)..(24): methylated C nucleotide
  modified_base (26)..(26): methylated C nucleotide
tgcgcgcccaccgccacgccacgcgcgta

SEQ ID NO: 406 - DNA, 30 bp, Artificial Sequence
  Synthetic
  modified_base (3)..(3): methylated C nucleotide
  modified_base (5)..(5): methylated C nucleotide
  modified_base (12)..(12): methylated C nucleotide
  modified_base (17)..(17): methylated C nucleotide
  modified_base (22)..(22): methylated C nucleotide
  modified_base (24)..(24): methylated C nucleotide
  modified_base (26)..(26): methylated C nucleotide
tgcgcgcccaccgccacgccacgcgcgtac

SEQ ID NO: 407 - DNA, 31 bp, Artificial Sequence
  Synthetic
  modified_base (3)..(3): methylated C nucleotide
  modified_base (5)..(5): methylated C nucleotide
  modified_base (12)..(12): methylated C nucleotide
  modified_base (17)..(17): methylated C nucleotide
  modified_base (22)..(22): methylated C nucleotide
  modified_base (24)..(24): methylated C nucleotide
  modified_base (26)..(26): methylated C nucleotide
tgcgcgcccaccgccacgccacgcgcgtacc

SEQ ID NO: 408 - DNA, 32 bp, Artificial Sequence
  Synthetic
  modified_base (3)..(3): methylated C nucleotide
  modified_base (5)..(5): methylated C nucleotide
  modified_base (12)..(12): methylated C nucleotide
  modified_base (17)..(17): methylated C nucleotide
  modified_base (22)..(22): methylated C nucleotide
  modified_base (24)..(24): methylated C nucleotide
  modified_base (26)..(26): methylated C nucleotide
tgcgcgcccaccgccacgccacgcgcgtacca

SEQ ID NO: 409 - DNA, 33 bp, Artificial Sequence
  Synthetic
  modified_base (3)..(3): methylated C nucleotide
  modified_base (5)..(5): methylated C nucleotide
  modified_base (12)..(12): methylated C nucleotide
  modified_base (17)..(17): methylated C nucleotide
  modified_base (22)..(22): methylated C nucleotide
  modified_base (24)..(24): methylated C nucleotide
  modified_base (26)..(26): methylated C nucleotide
tgcgcgcccaccgccacgccacgcgcgtaccag

SEQ ID NO: 410 - DNA, 30 bp, Artificial Sequence
  Synthetic
  modified_base (4)..(4): methylated C nucleotide
  modified_base (6)..(6): methylated C nucleotide
  modified_base (13)..(13): methylated C nucleotide
  modified_base (18)..(18): methylated C nucleotide
  modified_base (23)..(23): methylated C nucleotide
  modified_base (25)..(25): methylated C nucleotide
  modified_base (27)..(27): methylated C nucleotide
ctgcgcgcccaccgccacgccacgcgcgta

SEQ ID NO: 411 - DNA, 32 bp, Artificial Sequence
  Synthetic
  modified_base (5)..(5): methylated C nucleotide
  modified_base (7)..(7): methylated C nucleotide
  modified_base (14)..(14): methylated C nucleotide
  modified_base (19)..(19): methylated C nucleotide
  modified_base (24)..(24): methylated C nucleotide
  modified_base (26)..(26): methylated C nucleotide
  modified_base (28)..(28): methylated C nucleotide
actgcgcgcccaccgccacgccacgcgcgtac

SEQ ID NO: 412 - DNA, 34 bp, Artificial Sequence
  Synthetic
  modified_base (6)..(6): methylated C nucleotide
  modified_base (8)..(8): methylated C nucleotide
  modified_base (15)..(15): methylated C nucleotide
  modified_base (20)..(20): methylated C nucleotide
  modified_base (25)..(25): methylated C nucleotide
  modified_base (27)..(27): methylated C nucleotide
  modified_base (29)..(29): methylated C nucleotide
cactgcgcgcccaccgccacgccacgcgcgtacc

SEQ ID NO: 413 - DNA, 36 bp, Artificial Sequence
  Synthetic
  modified_base (7)..(7): methylated C nucleotide
  modified_base (9)..(9): methylated C nucleotide
  modified_base (16)..(16): methylated C nucleotide
  modified_base (21)..(21): methylated C nucleotide
  modified_base (26)..(26): methylated C nucleotide
  modified_base (28)..(28): methylated C nucleotide
  modified_base (30)..(30): methylated C nucleotide
ccactgcgcgcccaccgccacgccacgcgcgtacca

SEQ ID NO: 414 - DNA, 38 bp, Artificial Sequence
  Synthetic
  modified_base (8)..(8): methylated C nucleotide
  modified_base (10)..(10): methylated C nucleotide
  modified_base (17)..(17): methylated C nucleotide
  modified_base (22)..(22): methylated C nucleotide
  modified_base (27)..(27): methylated C nucleotide
  modified_base (29)..(29): methylated C nucleotide
  modified_base (31)..(31): methylated C nucleotide
accactgcgcgcccaccgccacgccacgcgcgtaccag

SEQ ID NO: 415 - DNA, 28 bp, Artificial Sequence
  Synthetic
  modified_base (6)..(6): methylated C nucleotide
  modified_base (8)..(8): methylated C nucleotide
  modified_base (15)..(15): methylated C nucleotide
  modified_base (20)..(20): methylated C nucleotide
  modified_base (25)..(25): methylated C nucleotide
  modified_base (27)..(27): methylated C nucleotide
cactgcgcgcccaccgccacgccacgcg

SEQ ID NO: 416 - DNA, 28 bp, Artificial Sequence
  Synthetic
  modified_base (9)..(9): methylated C nucleotide
  modified_base (11)..(11): methylated C nucleotide
  modified_base (18)..(18): methylated C nucleotide
  modified_base (23)..(23): methylated C nucleotide
  modified_base (28)..(28): methylated C nucleotide
aaccactgcgcgcccaccgccacgccac

SEQ ID NO: 417 - DNA, 28 bp, Artificial Sequence
  Synthetic
  modified_base (12)..(12): methylated C nucleotide
  modified_base (14)..(14): methylated C nucleotide
  modified_base (21)..(21): methylated C nucleotide
  modified_base (26)..(26): methylated C nucleotide
gagaaccactgcgcgcccaccgccacgc

SEQ ID NO: 418 - DNA, 28 bp, Artificial Sequence
  Synthetic
  modified_base (15)..(15): methylated C nucleotide
  modified_base (17)..(17): methylated C nucleotide
  modified_base (24)..(24): methylated C nucleotide
accgagaaccactgcgcgcccaccgcca

SEQ ID NO: 419 - DNA, 28 bp, Artificial Sequence
  Synthetic
  modified_base (18)..(18): methylated C nucleotide
  modified_base (20)..(20): methylated C nucleotide
  modified_base (27)..(27): methylated C nucleotide
cacaccgagaaccactgcgcgcccaccg

SEQ ID NO: 420 - DNA, 28 bp, Artificial Sequence
  Synthetic
  modified_base (2)..(2): methylated C nucleotide
  modified_base (9)..(9): methylated C nucleotide
  modified_base (14)..(14): methylated C nucleotide
  modified_base (19)..(19): methylated C nucleotide
  modified_base (21)..(21): methylated C nucleotide
  modified_base (23)..(23): methylated C nucleotide
gcgcccaccgccacgccacgcgcgtacc

SEQ ID NO: 421 - DNA, 28 bp, Artificial Sequence
  Synthetic
  modified_base (6)..(6): methylated C nucleotide
  modified_base (11)..(11): methylated C nucleotide
  modified_base (16)..(16): methylated C nucleotide
  modified_base (18)..(18): methylated C nucleotide
  modified_base (20)..(20): methylated C nucleotide
cccaccgccacgccacgcgcgtaccagg

SEQ ID NO: 422 - DNA, 28 bp, Artificial Sequence
  Synthetic
  modified_base (3)..(3): methylated C nucleotide
  modified_base (8)..(8): methylated C nucleotide
  modified_base (13)..(13): methylated C nucleotide
  modified_base (15)..(15): methylated C nucleotide
  modified_base (17)..(17): methylated C nucleotide
accgccacgccacgcgcgtaccaggctg

SEQ ID NO: 423 - DNA, 28 bp, Artificial Sequence
  Synthetic
  modified_base (5)..(5): methylated C nucleotide
  modified_base (10)..(10): methylated C nucleotide
  modified_base (12)..(12): methylated C nucleotide
  modified_base (14)..(14): methylated C nucleotide
gccacgccacgcgcgtaccaggctgcag

SEQ ID NO: 424 - DNA, 26 bp, Artificial Sequence
  Synthetic
  modified_base (1)..(1): methylated C nucleotide
  modified_base (3)..(3): methylated C nucleotide
  modified_base (10)..(10): methylated C nucleotide
  modified_base (15)..(15): methylated C nucleotide
  modified_base (20)..(20): methylated C nucleotide
  modified_base (22)..(22): methylated C nucleotide
  modified_base (24)..(24): methylated C nucleotide
cgcgcccaccgccacgccacgcgcgt

SEQ ID NO: 425 - DNA, 24 bp, Artificial Sequence
  Synthetic
  modified_base (1)..(1): methylated C nucleotide
  modified_base (8)..(8): methylated C nucleotide
  modified_base (13)..(13): methylated C nucleotide
  modified_base (18)..(18): methylated C nucleotide
  modified_base (20)..(20): methylated C nucleotide
  modified_base (22)..(22): methylated C nucleotide
cgcccaccgccacgccacgcgcgt

SEQ ID NO: 426 - DNA, 22 bp, Artificial Sequence
  Synthetic
  modified_base (6)..(6): methylated C nucleotide
  modified_base (11)..(11): methylated C nucleotide
  modified_base (16)..(16): methylated C nucleotide
  modified_base (18)..(18): methylated C nucleotide
  modified_base (20)..(20): methylated C nucleotide
cccaccgccacgccacgcgcgt

SEQ ID NO: 427 - DNA, 20 bp, Artificial Sequence
  Synthetic
  modified_base (4)..(4): methylated C nucleotide
  modified_base (9)..(9): methylated C nucleotide
  modified_base (14)..(14): methylated C nucleotide
  modified_base (16)..(16): methylated C nucleotide
  modified_base (18)..(18): methylated C nucleotide
caccgccacgccacgcgcgt

SEQ ID NO: 428 - DNA, 18 bp, Artificial Sequence
  Synthetic
  modified_base (2)..(2): methylated C nucleotide
  modified_base (7)..(7): methylated C nucleotide
  modified_base (12)..(12): methylated C nucleotide
  modified_base (14)..(14): methylated C nucleotide
  modified_base (16)..(16): methylated C nucleotide
ccgccacgccacgcgcgt

SEQ ID NO: 429 - DNA, 16 bp, Artificial Sequence
  Synthetic
  modified_base (5)..(5): methylated C nucleotide
  modified_base (10)..(10): methylated C nucleotide
  modified_base (12)..(12): methylated C nucleotide
  modified_base (14)..(14): methylated C nucleotide
gccacgccacgcgcgt

SEQ ID NO: 430 - DNA, 15 bp, Artificial Sequence
  Synthetic
  modified_base (4)..(4): methylated C nucleotide
  modified_base (9)..(9): methylated C nucleotide
  modified_base (11)..(11): methylated C nucleotide
  modified_base (13)..(13): methylated C nucleotide
ccacgccacgcgcgt

SEQ ID NO: 431 - DNA, 26 bp, Artificial Sequence
  Synthetic
  modified_base (3)..(3): methylated C nucleotide
  modified_base (5)..(5): methylated C nucleotide
  modified_base (12)..(12): methylated C nucleotide
  modified_base (17)..(17): methylated C nucleotide
  modified_base (22)..(22): methylated C nucleotide
  modified_base (24)..(24): methylated C nucleotide
  modified_base (26)..(26): methylated C nucleotide
tgcgcgcccaccgccacgccacgcgc

SEQ ID NO: 432 - DNA, 24 bp, Artificial Sequence
  Synthetic
  modified_base (3)..(3): methylated C nucleotide
  modified_base (5)..(5): methylated C nucleotide
  modified_base (12)..(12): methylated C nucleotide
  modified_base (17)..(17): methylated C nucleotide
  modified_base (22)..(22): methylated C nucleotide
  modified_base (24)..(24): methylated C nucleotide
tgcgcgcccaccgccacgccacgc

SEQ ID NO: 433 - DNA, 22 bp, Artificial Sequence
  Synthetic
  modified_base (3)..(3): methylated C nucleotide
  modified_base (5)..(5): methylated C nucleotide
  modified_base (12)..(12): methylated C nucleotide
  modified_base (17)..(17): methylated C nucleotide
  modified_base (22)..(22): methylated C nucleotide
tgcgcgcccaccgccacgccac

SEQ ID NO: 434 - DNA, 20 bp, Artificial Sequence
  Synthetic
  modified_base (3)..(3): methylated C nucleotide
  modified_base (5)..(5): methylated C nucleotide
  modified_base (12)..(12): methylated C nucleotide
  modified_base (17)..(17): methylated C nucleotide
tgcgcgcccaccgccacgcc

SEQ ID NO: 435 - DNA, 18 bp, Artificial Sequence
  Synthetic
  modified_base (3)..(3): methylated C nucleotide
  modified_base (5)..(5): methylated C nucleotide
  modified_base (12)..(12): methylated C nucleotide
  modified_base (17)..(17): methylated C nucleotide
tgcgcgcccaccgccacg

SEQ ID NO: 436 - DNA, 16 bp, Artificial Sequence
  Synthetic
  modified_base (3)..(3): methylated C nucleotide
  modified_base (5)..(5): methylated C nucleotide
  modified_base (12)..(12): methylated C nucleotide
tgcgcgcccaccgcca

SEQ ID NO: 437 - DNA, 15 bp, Artificial Sequence
  Synthetic
  modified_base (3)..(3): methylated C nucleotide
  modified_base (5)..(5): methylated C nucleotide
  modified_base (12)..(12): methylated C nucleotide
tgcgcgcccaccgcc

SEQ ID NO: 438 - DNA, 28 bp, Artificial Sequence
  Synthetic
  modified_base (3)..(3): methylated C nucleotide
  modified_base (5)..(5): methylated C nucleotide
  modified_base (12)..(12): methylated C nucleotide
  modified_base (17)..(17): methylated C nucleotide
  modified_base (22)..(22): methylated C nucleotide
  modified_base (24)..(24): methylated C nucleotide
  modified_base (26)..(26): methylated C nucleotide
tgcgcgcccaccgccgcgccacgcgcgt

SEQ ID NO: 439 - DNA, 28 bp, Artificial Sequence
  Synthetic
  modified_base (3)..(3): methylated C nucleotide
  modified_base (5)..(5): methylated C nucleotide
  modified_base (12)..(12): methylated C nucleotide
  modified_base (17)..(17): methylated C nucleotide
  modified_base (22)..(22): methylated C nucleotide
  modified_base (24)..(24): methylated C nucleotide
  modified_base (26)..(26): methylated C nucleotide
tgcgcgtccaccgccacgccacgcgcgt

SEQ ID NO: 440 - DNA, 28 bp, Artificial Sequence
  Synthetic
  modified_base (3)..(3): methylated C nucleotide
  modified_base (5)..(5): methylated C nucleotide
  modified_base (12)..(12): methylated C nucleotide
  modified_base (17)..(17): methylated C nucleotide
  modified_base (22)..(22): methylated C nucleotide
  modified_base (24)..(24): methylated C nucleotide
  modified_base (26)..(26): methylated C nucleotide
tgcgcgcccgccgccacgccacgcgcgt

SEQ ID NO: 441 - DNA, 25 bp, Artificial Sequence
  Synthetic
  modified_base (7)..(7): methylated C nucleotide
  modified_base (19)..(19): methylated C nucleotide
  modified_base (22)..(22): methylated C nucleotide
tgggtgcgtccctcctagcgccggg

SEQ ID NO: 442 - DNA, 26 bp, Artificial Sequence
  Synthetic
  modified_base (8)..(8): methylated C nucleotide
  modified_base (20)..(20): methylated C nucleotide
  modified_base (23)..(23): methylated C nucleotide
ctgggtgcgtccctcctagcgccggg

SEQ ID NO: 443 - DNA, 27 bp, Artificial Sequence
  Synthetic
  modified_base (9)..(9): methylated C nucleotide
  modified_base (21)..(21): methylated C nucleotide
  modified_base (24)..(24): methylated C nucleotide
cctgggtgcgtccctcctagcgccggg

SEQ ID NO: 444 - DNA, 28 bp, Artificial Sequence
  Synthetic
  modified_base (10)..(10): methylated C nucleotide
  modified_base (22)..(22): methylated C nucleotide
  modified_base (25)..(25): methylated C nucleotide
gcctgggtgcgtccctcctagcgccggg

SEQ ID NO: 445 - DNA, 29 bp, Artificial Sequence
  Synthetic
  modified_base (11)..(11): methylated C nucleotide
  modified_base (23)..(23): methylated C nucleotide
  modified_base (26)..(26): methylated C nucleotide
ggcctgggtgcgtccctcctagcgccggg

SEQ ID NO: 446 - DNA, 30 bp, Artificial Sequence
  Synthetic
  modified_base (12)..(12): methylated C nucleotide
  modified_base (24)..(24): methylated C nucleotide
  modified_base (27)..(27): methylated C nucleotide
aggcctgggtgcgtccctcctagcgccggg

SEQ ID NO: 447 - DNA, 26 bp, Artificial Sequence
  Synthetic
  modified_base (7)..(7): methylated C nucleotide
  modified_base (19)..(19): methylated C nucleotide
  modified_base (22)..(22): methylated C nucleotide
tgggtgcgtccctcctagcgccggga

SEQ ID NO: 448 - DNA, 27 bp, Artificial Sequence
  Synthetic
  modified_base (7)..(7): methylated C nucleotide
  modified_base (19)..(19): methylated C nucleotide
  modified_base (22)..(22): methylated C nucleotide
tgggtgcgtccctcctagcgccgggaa

SEQ ID NO: 449 - DNA, 28 bp, Artificial Sequence
  Synthetic
  modified_base (7)..(7): methylated C nucleotide
  modified_base (19)..(19): methylated C nucleotide
  modified_base (22)..(22): methylated C nucleotide
tgggtgcgtccctcctagcgccgggaag

SEQ ID NO: 450 - DNA, 29 bp, Artificial Sequence
  Synthetic
  modified_base (7)..(7): methylated C nucleotide
  modified_base (19)..(19): methylated C nucleotide
  modified_base (22)..(22): methylated C nucleotide
tgggtgcgtccctcctagcgccgggaagc

SEQ ID NO: 451 - DNA, 30 bp, Artificial Sequence
  Synthetic
  modified_base (7)..(7): methylated C nucleotide
  modified_base (19)..(19): methylated C nucleotide
  modified_base (22)..(22): methylated C nucleotide
tgggtgcgtccctcctagcgccgggaagct

SEQ ID NO: 452 - DNA, 27 bp, Artificial Sequence
  Synthetic
  modified_base (8)..(8): methylated C nucleotide
  modified_base (20)..(20): methylated C nucleotide
  modified_base (23)..(23): methylated C nucleotide
ctgggtgcgtccctcctagcgccggga

SEQ ID NO: 453 - DNA, 29 bp, Artificial Sequence
  Synthetic
  modified_base (9)..(9): methylated C nucleotide
  modified_base (21)..(21): methylated C nucleotide
  modified_base (24)..(24): methylated C nucleotide
cctgggtgcgtccctcctagcgccgggaa

SEQ ID NO: 454 - DNA, 31 bp, Artificial Sequence
  Synthetic
  modified_base (10)..(10): methylated C nucleotide
  modified_base (22)..(22): methylated C nucleotide
  modified_base (25)..(25): methylated C nucleotide
gcctgggtgcgtccctcctagcgccgggaag

SEQ ID NO: 455 - DNA, 33 bp, Artificial Sequence
  Synthetic
  modified_base (11)..(11): methylated C nucleotide
  modified_base (23)..(23): methylated C nucleotide
  modified_base (26)..(26): methylated C nucleotide
ggcctgggtgcgtccctcctagcgccgggaagc

SEQ ID NO: 456 - DNA, 35 bp, Artificial Sequence
  Synthetic
  modified_base (12)..(12): methylated C nucleotide
  modified_base (24)..(24): methylated C nucleotide
  modified_base (27)..(27): methylated C nucleotide
aggcctgggtgcgtccctcctagcgccgggaagct

SEQ ID NO: 457 - DNA, 25 bp, Artificial Sequence
  Synthetic
  modified_base (10)..(10)
  modified_base (22)..(22)
  modified_base (25)..(25)
gcctgggtgcgtccctcctagcgcc

SEQ ID NO: 458 - DNA, 25 bp, Artificial Sequence
  Synthetic
  modified_base (13)..(13): methylated C nucleotide
  modified_base (25)..(25): methylated C nucleotide
caggcctgggtgcgtccctcctagc

SEQ ID NO: 459 - DNA, 25 bp, Artificial Sequence
  Synthetic
  modified_base (16)..(16): methylated C nucleotide
gcgcaggcctgggtgcgtccctcct

SEQ ID NO: 460 - DNA, 25 bp, Artificial Sequence
  Synthetic
  modified_base (19)..(19): methylated C nucleotide
ttcgcgcaggcctgggtgcgtccct

SEQ ID NO: 461 - DNA, 25 bp, Artificial Sequence
  Synthetic
  modified_base (22)..(22): methylated C nucleotide
ctcttcgcgcaggcctgggtgcgtc

SEQ ID NO: 462 - DNA, 25 bp, Artificial Sequence
  Synthetic
  modified_base (4)..(4): methylated C nucleotide
  modified_base (16)..(16): methylated C nucleotide
  modified_base (19)..(19): methylated C nucleotide
gtgcgtccctcctagcgccgggaag

SEQ ID NO: 463 - DNA, 25 bp, Artificial Sequence
  Synthetic
  modified_base (1)..(1): methylated C nucleotide
  modified_base (13)..(13): methylated C nucleotide
  modified_base (16)..(16): methylated C nucleotide
cgtccctcctagcgccgggaagctg

SEQ ID NO: 464 - DNA, 25 bp, Artificial Sequence
  Synthetic
  modified_base (10)..(10): methylated C nucleotide
  modified_base (13)..(13): methylated C nucleotide
ccctcctagcgccgggaagctgggt

SEQ ID NO: 465 - DNA, 25 bp, Artificial Sequence
  Synthetic
  modified_base (7)..(7): methylated C nucleotide
  modified_base (10)..(10): methylated C nucleotide
tcctagcgccgggaagctgggttgc

SEQ ID NO: 466 - DNA, 25 bp, Artificial Sequence
  Synthetic
  modified_base (4)..(4): methylated C nucleotide
  modified_base (7)..(7): methylated C nucleotide
tagcgccgggaagctgggttgcctg

SEQ ID NO: 467 - DNA, 23 bp, Artificial Sequence
  Synthetic
  modified_base (5)..(5): methylated C nucleotide
  modified_base (17)..(17): methylated C nucleotide
  modified_base (20)..(20): methylated C nucleotide
ggtgcgtccctcctagcgccggg

SEQ ID NO: 468 - DNA, 21 bp, Artificial Sequence
  Synthetic
  modified_base (3)..(3): methylated C nucleotide
  modified_base (15)..(15): methylated C nucleotide
  modified_base (18)..(18): methylated C nucleotide
tgcgtccctcctagcgccggg

SEQ ID NO: 469 - DNA, 19 bp, Artificial Sequence
  Synthetic
  modified_base (1)..(1): methylated C nucleotide
  modified_base (13)..(13): methylated C nucleotide
  modified_base (16)..(16): methylated C nucleotide
cgtccctcctagcgccggg

SEQ ID NO: 470 - DNA, 17 bp, Artificial Sequence
  Synthetic
  modified_base (11)..(11): methylated C nucleotide
  modified_base (14)..(14): methylated C nucleotide
tccctcctagcgccggg

SEQ ID NO: 471 - skipped

SEQ ID NO: 472 - DNA, 15 bp, Artificial Sequence
  Synthetic
  modified_base (9)..(9): methylated C nucleotide
  modified_base (12)..(12): methylated C nucleotide
cctcctagcgccggg

SEQ ID NO: 473 - DNA, 23 bp, Artificial Sequence
  Synthetic
  modified_base (7)..(7): methylated C nucleotide
  modified_base (19)..(19): methylated C nucleotide
  modified_base (22)..(22): methylated C nucleotide
tgggtgcgtccctcctagcgccg

SEQ ID NO: 474 - DNA, 21 bp, Artificial Sequence
  Synthetic
  modified_base (7)..(7): methylated C nucleotide
  modified_base (19)..(19): methylated C nucleotide
tgggtgcgtccctcctagcgc

SEQ ID NO: 475 - DNA, 19 bp, Artificial Sequence
  Synthetic
  modified_base (7)..(7): methylated C nucleotide
  modified_base (19)..(19): methylated C nucleotide
tgggtgcgtccctcctagc

SEQ ID NO: 476 - DNA, 17 bp, Artificial Sequence
  Synthetic
  modified_base (7)..(7): methylated C nucleotide
tgggtgcgtccctccta

SEQ ID NO: 477 - DNA, 15 bp, Artificial Sequence
  Synthetic
  modified_base (7)..(7): methylated C nucleotide
tgggtgcgtccctcc

SEQ ID NO: 478 - DNA, 25 bp, Artificial Sequence
  Synthetic
  modified_base (7)..(7): methylated C nucleotide
  modified_base (19)..(19): methylated C nucleotide
  modified_base (22)..(22): methylated C nucleotide
tgggtgcatccctcctagcgccggg

SEQ ID NO: 479 - DNA, 25 bp, Artificial Sequence
  Synthetic
  modified_base (7)..(7): methylated C nucleotide
  modified_base (19)..(19): methylated C nucleotide
  modified_base (22)..(22): methylated C nucleotide
tgtgtgcgtccctcctagcgccggg

SEQ ID NO: 480 - DNA, 25 bp, Artificial Sequence
  Synthetic
  modified_base (7)..(7): methylated C nucleotide
  modified_base (19)..(19): methylated C nucleotide
  modified_base (22)..(22): methylated C nucleotide
tgggtgcgtccctcctaccgccggg

SEQ ID NO: 481 - DNA, 26 bp, Artificial Sequence
  Synthetic
  modified_base (3)..(3): methylated C nucleotide
  modified_base (6)..(6): methylated C nucleotide
  modified_base (20)..(20): methylated C nucleotide
ttcgccgcaggcctgggtgcgtccct

SEQ ID NO: 482 - DNA, 27 bp, Artificial Sequence
  Synthetic
  modified_base (4)..(4): methylated C nucleotide
  modified_base (7)..(7): methylated C nucleotide
  modified_base (21)..(21): methylated C nucleotide
cttcgccgcaggcctgggtgcgtccct

SEQ ID NO: 483 - DNA, 28 bp, Artificial Sequence
  Synthetic
  modified_base (5)..(5): methylated C nucleotide
  modified_base (8)..(8): methylated C nucleotide
  modified_base (22)..(22): methylated C nucleotide
tcttcgccgcaggcctgggtgcgtccct

SEQ ID NO: 484 - DNA, 29 bp, Artificial Sequence
  Synthetic
  modified_base (6)..(6): methylated C nucleotide
  modified_base (9)..(9): methylated C nucleotide
  modified_base (23)..(23): methylated C nucleotide
ctcttcgccgcaggcctgggtgcgtccct

SEQ ID NO: 485 - DNA, 30 bp, Artificial Sequence
  Synthetic
  modified_base (7)..(7): methylated C nucleotide
  modified_base (10)..(10): methylated C nucleotide
  modified_base (24)..(24): methylated C nucleotide
tctcttcgccgcaggcctgggtgcgtccct

SEQ ID NO: 486 - DNA, 31 bp, Artificial Sequence
  Synthetic
  modified_base (8)..(8): methylated C nucleotide
  modified_base (11)..(11): methylated C nucleotide
  modified_base (25)..(25): methylated C nucleotide
ctctcttcgccgcaggcctgggtgcgtccct

SEQ ID NO: 487 - DNA, 27 bp, Artificial Sequence
  Synthetic
  modified_base (3)..(3): methylated C nucleotide
  modified_base (6)..(6): methylated C nucleotide
  modified_base (20)..(20): methylated C nucleotide
ttcgccgcaggcctgggtgcgtccctc

SEQ ID NO: 488 - DNA, 28 bp, Artificial Sequence
  Synthetic
  modified_base (3)..(3): methylated C nucleotide
  modified_base (6)..(6): methylated C nucleotide
  modified_base (20)..(20): methylated C nucleotide
ttcgccgcaggcctgggtgcgtccctcc

SEQ ID NO: 489 - DNA, 29 bp, Artificial Sequence
  Synthetic
  modified_base (3)..(3): methylated C nucleotide
  modified_base (6)..(6): methylated C nucleotide
  modified_base (20)..(20): methylated C nucleotide
ttcgccgcaggcctgggtgcgtccctcct

SEQ ID NO: 490 - DNA, 30 bp, Artificial Sequence
  Synthetic
  modified_base (3)..(3): methylated C nucleotide
  modified_base (6)..(6): methylated C nucleotide
  modified_base (20)..(20): methylated C nucleotide
ttcgccgcaggcctgggtgcgtccctccta

SEQ ID NO: 491 - DNA, 31 bp, Artificial Sequence
  Synthetic
  modified_base (3)..(3): methylated C nucleotide
  modified_base (6)..(6): methylated C nucleotide
  modified_base (20)..(20): methylated C nucleotide
ttcgccgcaggcctgggtgcgtccctcctag

SEQ ID NO: 492 - DNA, 28 bp, Artificial Sequence
  Synthetic
  modified_base (4)..(4): methylated C nucleotide
  modified_base (7)..(7): methylated C nucleotide
  modified_base (21)..(21): methylated C nucleotide
cttcgccgcaggcctgggtgcgtccctc

SEQ ID NO: 493 - DNA, 30 bp, Artificial Sequence
  Synthetic
  modified_base (5)..(5): methylated C nucleotide
  modified_base (8)..(8): methylated C nucleotide
  modified_base (22)..(22): methylated C nucleotide
tcttcgccgcaggcctgggtgcgtccctcc

SEQ ID NO: 494 - DNA, 32 bp, Artificial Sequence
  Synthetic
  modified_base (6)..(6): methylated C nucleotide
  modified_base (9)..(9): methylated C nucleotide
  modified_base (23)..(23): methylated C nucleotide
ctcttcgccgcaggcctgggtgcgtccctcct

SEQ ID NO: 495 - DNA, 34 bp, Artificial Sequence
  Synthetic
  modified_base (7)..(7): methylated C nucleotide
  modified_base (10)..(10): methylated C nucleotide
  modified_base (24)..(24): methylated C nucleotide
tctcttcgccgcaggcctgggtgcgtccctccta

SEQ ID NO: 496 - DNA, 36 bp, Artificial Sequence
  Synthetic
  modified_base (8)..(8): methylated C nucleotide
  modified_base (11)..(11): methylated C nucleotide
  modified_base (25)..(25): methylated C nucleotide
ctctcttcgccgcaggcctgggtgcgtccctcctag

SEQ ID NO: 497 - DNA, 26 bp, Artificial Sequence
  Synthetic
  modified_base (6)..(6): methylated C nucleotide
  modified_base (9)..(9): methylated C nucleotide
  modified_base (23)..(23): methylated C nucleotide
ctcttcgccgcaggcctgggtgcgtc

SEQ ID NO: 498 - DNA, 26 bp, Artificial Sequence
  Synthetic
  modified_base (9)..(9): methylated C nucleotide
  modified_base (12)..(12): methylated C nucleotide
  modified_base (26)..(26): methylated C nucleotide
cctctcttcgccgcaggcctgggtgc

SEQ ID NO: 499 - DNA, 26 bp, Artificial Sequence
  Synthetic
  modified_base (12)..(12): methylated C nucleotide
  modified_base (15)..(15): methylated C nucleotide
ctccctctcttcgccgcaggcctggg

SEQ ID NO: 500 - DNA, 26 bp, Artificial Sequence
  Synthetic
  modified_base (15)..(15): methylated C nucleotide
  modified_base (18)..(18): methylated C nucleotide
tttctccctctcttcgccgcaggcct

SEQ ID NO: 501 - DNA, 26 bp, Artificial Sequence
  Synthetic
  modified_base (18)..(18): methylated C nucleotide
  modified_base (21)..(21): methylated C nucleotide
cactttctccctctcttcgccgcagg

SEQ ID NO: 502 - DNA, 26 bp, Artificial Sequence
  Synthetic
  modified_base (3)..(3): methylated C nucleotide
  modified_base (17)..(17): methylated C nucleotide
gccgcaggcctgggtgcgtccctcct

SEQ ID NO: 503 - DNA, 26 bp, Artificial Sequence
  Synthetic
  modified_base (14)..(14): methylated C nucleotide
gcaggcctgggtgcgtccctcctagc

SEQ ID NO: 504 - DNA, 26 bp, Artificial Sequence
  Synthetic
  modified_base (11)..(11): methylated C nucleotide
ggcctgggtgcgtccctcctagcgcc

SEQ ID NO: 505 - DNA, 26 bp, Artificial Sequence
  Synthetic
  modified_base (8)..(8): methylated C nucleotide
ctgggtgcgtccctcctagcgccggg

SEQ ID NO: 506 - DNA, 26 bp, Artificial Sequence
  Synthetic
  modified_base (5)..(5): methylated C nucleotide
ggtgcgtccctcctagcgccgggaag

SEQ ID NO: 507 - DNA, 24 bp, Artificial Sequence
  Synthetic
  modified_base (1)..(1): methylated C nucleotide
  modified_base (4)..(4): methylated C nucleotide
  modified_base (18)..(18): methylated C nucleotide
cgccgcaggcctgggtgcgtccct

SEQ ID NO: 508 - DNA, 22 bp, Artificial Sequence
  Synthetic
  modified_base (2)..(2): methylated C nucleotide
  modified_base (16)..(16): methylated C nucleotide
ccgcaggcctgggtgcgtccct

SEQ ID NO: 509 - DNA, 20 bp, Artificial Sequence
  Synthetic
  modified_base (14)..(14): methylated C nucleotide
gcaggcctgggtgcgtccct

SEQ ID NO: 510 - DNA, 18 bp, Artificial Sequence
  Synthetic
  modified_base (12)..(12): methylated C nucleotide
aggcctgggtgcgtccct

SEQ ID NO: 511 - DNA, 16 bp, Artificial Sequence
  Synthetic
  modified_base (10)..(10): methylated C nucleotide
gcctgggtgcgtccct

SEQ ID NO: 512 - DNA, 15 bp, Artificial Sequence
  Synthetic
  modified_base (9)..(9): methylated C nucleotide
cctgggtgcgtccct

SEQ ID NO: 513 - DNA, 24 bp, Artificial Sequence
  Synthetic
  modified_base (3)..(3): methylated C nucleotide
  modified_base (6)..(6): methylated C nucleotide
  modified_base (20)..(20): methylated C nucleotide
ttcgccgcaggcctgggtgcgtcc

SEQ ID NO: 514 - DNA, 22 bp, Artificial Sequence
  Synthetic
  modified_base (3)..(3): methylated C nucleotide
  modified_base (6)..(6): methylated C nucleotide
  modified_base (20)..(20): methylated C nucleotide
ttcgccgcaggcctgggtgcgt

SEQ ID NO: 515 - DNA, 20 bp, Artificial Sequence
  Synthetic
  modified_base (3)..(3): methylated C nucleotide
  modified_base (6)..(6): methylated C nucleotide
  modified_base (20)..(20): methylated C nucleotide
ttcgccgcaggcctgggtgc

SEQ ID NO: 516 - DNA, 18 bp, Artificial Sequence
  Synthetic
  modified_base (3)..(3): methylated C nucleotide
  modified_base (6)..(6): methylated C nucleotide
ttcgccgcaggcctgggt

SEQ ID NO: 517 - DNA, 16 bp, Artificial Sequence
  Synthetic
  modified_base (3)..(3): methylated C nucleotide
  modified_base (6)..(6): methylated C nucleotide
ttcgccgcaggcctgg

SEQ ID NO: 518 - DNA, 15 bp, Artificial Sequence
  Synthetic
  modified_base (3)..(3): methylated C nucleotide
  modified_base (6)..(6): methylated C nucleotide
ttcgccgcaggcctg

SEQ ID NO: 519 - DNA, 26 bp, Artificial Sequence
  Synthetic
  modified_base (3)..(3): methylated C nucleotide
  modified_base (6)..(6): methylated C nucleotide
  modified_base (20)..(20): methylated C nucleotide
ttcaccgcaggcctgggtgcgtccct

SEQ ID NO: 520 - DNA, 26 bp, Artificial Sequence
  Synthetic
  modified_base (3)..(3): methylated C nucleotide
  modified_base (6)..(6): methylated C nucleotide
  modified_base (20)..(20): methylated C nucleotide
ttcgccgcaggcctgtgtgcgtccct

SEQ ID NO: 521 - DNA, 26 bp, Artificial Sequence
  Synthetic
  modified_base (3)..(3): methylated C nucleotide
  modified_base (6)..(6): methylated C nucleotide
  modified_base (20)..(20): methylated C nucleotide
ttcgccgcaggcctgggtgcgtacct

SEQ ID NO: 522 - DNA, 24 bp, Artificial Sequence
  Synthetic
  modified_base (13)..(13): methylated C nucleotide
  modified_base (20)..(20): methylated C nucleotide
tgccccctcccccggagtccggga

SEQ ID NO: 523 - DNA, 25 bp, Artificial Sequence
  Synthetic
  modified_base (14)..(14): methylated C nucleotide
  modified_base (21)..(21): methylated C nucleotide
ctgccccctcccccggagtccggga

SEQ ID NO: 524 - DNA, 26 bp, Artificial Sequence
  Synthetic
  modified_base (15)..(15): methylated C nucleotide
  modified_base (22)..(22): methylated C nucleotide
tctgccccctcccccggagtccggga

SEQ ID NO: 525 - DNA, 27 bp, Artificial Sequence
  Synthetic
  modified_base (16)..(16): methylated C nucleotide
  modified_base (23)..(23): methylated C nucleotide
ctctgccccctcccccggagtccggga

SEQ ID NO: 526 - DNA, 28 bp, Artificial Sequence
  Synthetic
  modified_base (17)..(17): methylated C nucleotide
  modified_base (24)..(24): methylated C nucleotide
actctgccccctcccccggagtccggga

SEQ ID NO: 527 - DNA, 29 bp, Artificial Sequence
  Synthetic
  modified_base (18)..(18): methylated C nucleotide
  modified_base (25)..(25): methylated C nucleotide
gactctgccccctcccccggagtccggga

SEQ ID NO: 528 - DNA, 25 bp, Artificial Sequence
  Synthetic
  modified_base (13)..(13): methylated C nucleotide
  modified_base (20)..(20): methylated C nucleotide
tgccccctcccccggagtccgggat

SEQ ID NO: 529 - DNA, 26 bp, Artificial Sequence
  Synthetic
  modified_base (13)..(13): methylated C nucleotide
  modified_base (20)..(20): methylated C nucleotide
tgccccctcccccggagtccgggata

SEQ ID NO: 530 - DNA, 27 bp, Artificial Sequence
  Synthetic
  modified_base (13)..(13): methylated C nucleotide
  modified_base (20)..(20): methylated C nucleotide
tgccccctcccccggagtccgggataa

SEQ ID NO: 531 - DNA, 28 bp, Artificial Sequence
  Synthetic
  modified_base (13)..(13): methylated C nucleotide
  modified_base (20)..(20): methylated C nucleotide
tgccccctcccccggagtccgggataaa

SEQ ID NO: 532 - DNA, 29 bp, Artificial Sequence
  Synthetic
  modified_base (13)..(13): methylated C nucleotide
  modified_base (20)..(20): methylated C nucleotide
tgccccctcccccggagtccgggataaat

SEQ ID NO: 533 - DNA, 26 bp, Artificial Sequence
  Synthetic
  modified_base (14)..(14): methylated C nucleotide
  modified_base (21)..(21): methylated C nucleotide
ctgccccctcccccggagtccgggat

SEQ ID NO: 534 - DNA, 28 bp, Artificial Sequence
  Synthetic
  modified_base (15)..(15): methylated C nucleotide
  modified_base (22)..(22): methylated C nucleotide
tctgccccctcccccggagtccgggata

SEQ ID NO: 535 - DNA, 30 bp, Artificial Sequence
  Synthetic
  modified_base (16)..(16): methylated C nucleotide
  modified_base (23)..(23): methylated C nucleotide
ctctgccccctcccccggagtccgggataa

SEQ ID NO: 536 - DNA, 32 bp, Artificial Sequence
  Synthetic
  modified_base (17)..(17): methylated C nucleotide
  modified_base (24)..(24): methylated C nucleotide
actctgccccctcccccggagtccgggataaa

SEQ ID NO: 537 - DNA, 34 bp, Artificial Sequence
  Synthetic
  modified_base (18)..(18): methylated C nucleotide
  modified_base (25)..(25): methylated C nucleotide
gactctgccccctcccccggagtccgggataaat

SEQ ID NO: 538 - DNA, 24 bp, Artificial Sequence
  Synthetic
  modified_base (16)..(16): methylated C nucleotide
  modified_base (23)..(23): methylated C nucleotide
ctctgccccctcccccggagtccg

SEQ ID NO: 539 - DNA, 24 bp, Artificial Sequence
  Synthetic
  modified_base (19)..(19): methylated C nucleotide
tgactctgccccctcccccggagt

SEQ ID NO: 540 - DNA, 24 bp, Artificial Sequence
  Synthetic
  modified_base (22)..(22): methylated C nucleotide
tggtgactctgccccctcccccgg

SEQ ID NO: 541 - skipped

SEQ ID NO: 542 - DNA, 24 bp, Artificial Sequence
  Synthetic
ggctggtgactctgccccctcccc

SEQ ID NO: 543 - DNA, 24 bp, Artificial Sequence
  Synthetic
agaggctggtgactctgccccctc

SEQ ID NO: 544 - DNA, 24 bp, Artificial Sequence
  Synthetic
  modified_base (10)..(10): methylated C nucleotide
  modified_base (17)..(17): methylated C nucleotide
cccctcccccggagtccgggataa

SEQ ID NO: 545 - DNA, 24 bp, Artificial Sequence
  Synthetic
  modified_base (7)..(7): methylated C nucleotide
  modified_base (14)..(14): methylated C nucleotide
ctcccccggagtccgggataaatt

SEQ ID NO: 546 - DNA, 24 bp, Artificial Sequence
  Synthetic
  modified_base (4)..(4): methylated C nucleotide
  modified_base (11)..(11): methylated C nucleotide
ccccggagtccgggataaattccc

SEQ ID NO: 547 - DNA, 24 bp, Artificial Sequence
  Synthetic
  modified_base (1)..(1): methylated C nucleotide
  modified_base (8)..(8): methylated C nucleotide
cggagtccgggataaattccctag

SEQ ID NO: 548 - DNA, 24 bp, Artificial Sequence
  Synthetic
  modified_base (5)..(5): methylated C nucleotide
agtccgggataaattccctaggct

SEQ ID NO: 549 - DNA, 22 bp, Artificial Sequence
  Synthetic
  modified_base (11)..(11): methylated C nucleotide
  modified_base (18)..(18): methylated C nucleotide
ccccctcccccggagtccggga

SEQ ID NO: 550 - DNA, 20 bp, Artificial Sequence
  Synthetic
  modified_base (9)..(9): methylated C nucleotide
  modified_base (16)..(16): methylated C nucleotide
ccctcccccggagtccggga

SEQ ID NO: 551 - DNA, 18 bp, Artificial Sequence
  Synthetic
  modified_base (7)..(7): methylated C nucleotide
  modified_base (14)..(14): methylated C nucleotide
ctcccccggagtccggga

SEQ ID NO: 552 - DNA, 16 bp, Artificial Sequence
  Synthetic
  modified_base (5)..(5): methylated C nucleotide
  modified_base (12)..(12): methylated C nucleotide
cccccggagtccggga

SEQ ID NO: 553 - DNA, 15 bp, Artificial Sequence
  Synthetic
  modified_base (4)..(4): methylated C nucleotide
  modified_base (11)..(11): methylated C nucleotide
ccccggagtccggga

SEQ ID NO: 554 - DNA, 22 bp, Artificial Sequence
  Synthetic
  modified_base (13)..(13): methylated C nucleotide
  modified_base (20)..(20): methylated C nucleotide
tgccccctcccccggagtccgg

SEQ ID NO: 555 - DNA, 20 bp, Artificial Sequence
  Synthetic
  modified_base (13)..(13): methylated C nucleotide
  modified_base (20)..(20): methylated C nucleotide
tgccccctcccccggagtcc

SEQ ID NO: 556 - DNA, 18 bp, Artificial Sequence
  Synthetic
  modified_base (13)..(13): methylated C nucleotide
tgccccctcccccggagt

SEQ ID NO: 557 - DNA, 16 bp, Artificial Sequence
  Synthetic
  modified_base (13)..(13): methylated C nucleotide
tgccccctcccccgga

SEQ ID NO: 558 - DNA, 15 bp, Artificial Sequence
  Synthetic
  modified_base (13)..(13): methylated C nucleotide
tgccccctcccccgg

SEQ ID NO: 559 - DNA, 24 bp, Artificial Sequence
  Synthetic
  modified_base (13)..(13): methylated C nucleotide
  modified_base (20)..(20): methylated C nucleotide
tgccccctctcccggagtccggga

SEQ ID NO: 560 - DNA, 24 bp, Artificial Sequence
  Synthetic
  modified_base (13)..(13): methylated C nucleotide
  modified_base (20)..(20): methylated C nucleotide
tgccccctcccccggagtacggga

SEQ ID NO: 561 - DNA, 24 bp, Artificial Sequence
  Synthetic
  modified_base (13)..(13): methylated C nucleotide
  modified_base (20)..(20): methylated C nucleotide
tgcccgctcccccggagtccggga

SEQ ID NO: 562 - DNA, 33 bp, Artificial Sequence; identical to SEQ ID NO: 36
  Synthetic
  modified_base (13)..(13): methylated C nucleotide
  modified_base (15)..(15): methylated C nucleotide
  modified_base (26)..(26): methylated C nucleotide

SEQ ID NO: 563 - DNA, 34 bp, Artificial Sequence
  Synthetic
  modified_base (14)..(14): methylated C nucleotide
  modified_base (16)..(16): methylated C nucleotide
  modified_base (27)..(27): methylated C nucleotide
gattgggagcaagcgcgctcccagctcgccccct

SEQ ID NO: 564 - DNA, 35 bp, Artificial Sequence
  Synthetic
  modified_base (15)..(15): methylated C nucleotide
  modified_base (17)..(17): methylated C nucleotide
  modified_base (28)..(28): methylated C nucleotide
tgattgggagcaagcgcgctcccagctcgccccct

SEQ ID NO: 565 - DNA, 36 bp, Artificial Sequence
  Synthetic
  modified_base (16)..(16): methylated C nucleotide
  modified_base (18)..(18): methylated C nucleotide
  modified_base (29)..(29): methylated C nucleotide
gtgattgggagcaagcgcgctcccagctcgccccct

SEQ ID NO: 566 - DNA, 37 bp, Artificial Sequence
  Synthetic
  modified_base (17)..(17): methylated C nucleotide
  modified_base (19)..(19): methylated C nucleotide
  modified_base (30)..(30): methylated C nucleotide
tgtgattgggagcaagcgcgctcccagctcgccccct

SEQ ID NO: 567 - DNA, 38 bp, Artificial Sequence
  Synthetic
  modified_base (18)..(18): methylated C nucleotide
  modified_base (20)..(20): methylated C nucleotide
  modified_base (31)..(31): methylated C nucleotide
ctgtgattgggagcaagcgcgctcccagctcgccccct

SEQ ID NO: 568 - DNA, 34 bp, Artificial Sequence
  Synthetic
  modified_base (13)..(13): methylated C nucleotide
  modified_base (15)..(15): methylated C nucleotide
  modified_base (26)..(26): methylated C nucleotide
attgggagcaagcgcgctcccagctcgccccctc

SEQ ID NO: 569 - DNA, 35 bp, Artificial Sequence
  Synthetic
  modified_base (13)..(13): methylated C nucleotide
  modified_base (15)..(15): methylated C nucleotide
  modified_base (26)..(26): methylated C nucleotide
attgggagcaagcgcgctcccagctcgccccctcc

SEQ ID NO: 570 - DNA, 36 bp, Artificial Sequence
  Synthetic
  modified_base (13)..(13): methylated C nucleotide
  modified_base (15)..(15): methylated C nucleotide
  modified_base (26)..(26): methylated C nucleotide
attgggagcaagcgcgctcccagctcgccccctcca

SEQ ID NO: 571 - DNA, 37 bp, Artificial Sequence
  Synthetic
  modified_base (13)..(13): methylated C nucleotide
  modified_base (15)..(15): methylated C nucleotide
  modified_base (26)..(26): methylated C nucleotide
attgggagcaagcgcgctcccagctcgccccctccaa

SEQ ID NO: 572 - DNA, 38 bp, Artificial Sequence
  Synthetic
  modified_base (13)..(13): methylated C nucleotide
  modified_base (15)..(15): methylated C nucleotide
  modified_base (26)..(26): methylated C nucleotide
attgggagcaagcgcgctcccagctcgccccctccaac

SEQ ID NO: 573 - DNA, 35 bp, Artificial Sequence
  Synthetic
gattgggagcaagcgcgctcccagctcgccccctc

SEQ ID NO: 574 - DNA, 37 bp, Artificial Sequence
  Synthetic
tgattgggagcaagcgcgctcccagctcgccccctcc

SEQ ID NO: 575 - DNA, 39 bp, Artificial Sequence
  Synthetic
gtgattgggagcaagcgcgctcccagctcgccccctcca

SEQ ID NO: 576 - DNA, 41 bp, Artificial Sequence
  Synthetic
tgtgattgggagcaagcgcgctcccagctcgccccctccaa

SEQ ID NO: 577 - DNA, 43 bp, Artificial Sequence
  Synthetic
ctgtgattgggagcaagcgcgctcccagctcgccccctccaac

SEQ ID NO: 578 - DNA, 33 bp, Artificial Sequence
  Synthetic
  modified_base (16)..(16): methylated C nucleotide
  modified_base (18)..(18): methylated C nucleotide
  modified_base (29)..(29): methylated C nucleotide
gtgattgggagcaagcgcgctcccagctcgccc

SEQ ID NO: 579 - DNA, 33 bp, Artificial Sequence
  Synthetic
  modified_base (19)..(19): methylated C nucleotide
  modified_base (21)..(21): methylated C nucleotide
  modified_base (32)..(32): methylated C nucleotide
cctgtgattgggagcaagcgcgctcccagctcg

SEQ ID NO: 580 - DNA, 33 bp, Artificial Sequence
  Synthetic
  modified_base (22)..(22): methylated C nucleotide
  modified_base (24)..(24): methylated C nucleotide
tctcctgtgattgggagcaagcgcgctcccagc

SEQ ID NO: 581 - DNA, 33 bp, Artificial Sequence
  Synthetic
  modified_base (25)..(25): methylated C nucleotide
  modified_base (27)..(27): methylated C nucleotide
ccttctcctgtgattgggagcaagcgcgctccc

SEQ ID NO: 582 - DNA, 33 bp, Artificial Sequence
  Synthetic
  modified_base (28)..(28): methylated C nucleotide
  modified_base (30)..(30): methylated C nucleotide
cctccttctcctgtgattgggagcaagcgcgct

SEQ ID NO: 583 - DNA, 33 bp, Artificial Sequence
  Synthetic
  modified_base (10)..(10): methylated C nucleotide
  modified_base (12)..(12): methylated C nucleotide
  modified_base (23)..(23): methylated C nucleotide
gggagcaagcgcgctcccagctcgccccctcca

SEQ ID NO: 584 - DNA, 33 bp, Artificial Sequence
  Synthetic
  modified_base (7)..(7): methylated C nucleotide
  modified_base (9)..(9): methylated C nucleotide
  modified_base (20)..(20): methylated C nucleotide
agcaagcgcgctcccagctcgccccctccaact

SEQ ID NO: 585 - DNA, 33 bp, Artificial Sequence
  Synthetic
  modified_base (4)..(4): methylated C nucleotide
  modified_base (6)..(6): methylated C nucleotide
  modified_base (17)..(17): methylated C nucleotide
aagcgcgctcccagctcgccccctccaactgca

SEQ ID NO: 586 - DNA, 33 bp, Artificial Sequence
  Synthetic
  modified_base (1)..(1): methylated C nucleotide
  modified_base (3)..(3): methylated C nucleotide
  modified_base (14)..(14): methylated C nucleotide
cgcgctcccagctcgccccctccaactgcattc

SEQ ID NO: 587 - DNA, 33 bp, Artificial Sequence
  Synthetic
  modified_base (11)..(11): methylated C nucleotide
gctcccagctcgccccctccaactgcattccaa

SEQ ID NO: 588 - DNA, 31 bp, Artificial Sequence
  Synthetic
  modified_base (11)..(11): methylated C nucleotide
  modified_base (13)..(13): methylated C nucleotide
  modified_base (24)..(24): methylated C nucleotide
tgggagcaagcgcgctcccagctcgccccct

SEQ ID NO: 589 - DNA, 29 bp, Artificial Sequence
  Synthetic
  modified_base (9)..(9): methylated C nucleotide
  modified_base (11)..(11): methylated C nucleotide
  modified_base (22)..(22): methylated C nucleotide
ggagcaagcgcgctcccagctcgccccct

SEQ ID NO: 590 - DNA, 27 bp, Artificial Sequence
  Synthetic
  modified_base (7)..(7): methylated C nucleotide
  modified_base (9)..(9): methylated C nucleotide
  modified_base (20)..(20): methylated C nucleotide
agcaagcgcgctcccagctcgccccct

SEQ ID NO: 591 - DNA, 25 bp, Artificial Sequence
  Synthetic
  modified_base (5)..(5): methylated C nucleotide
  modified_base (7)..(7): methylated C nucleotide
  modified_base (18)..(18): methylated C nucleotide
caagcgcgctcccagctcgccccct

SEQ ID NO: 592 - DNA, 23 bp, Artificial Sequence
  Synthetic
  modified_base (3)..(3): methylated C nucleotide
  modified_base (5)..(5): methylated C nucleotide
  modified_base (16)..(16): methylated C nucleotide
agcgcgctcccagctcgccccct

SEQ ID NO: 593 - DNA, 21 bp, Artificial Sequence
  Synthetic
  modified_base (1)..(1): methylated C nucleotide
  modified_base (3)..(3): methylated C nucleotide
  modified_base (14)..(14): methylated C nucleotide
cgcgctcccagctcgccccct

SEQ ID NO: 594 - DNA, 19 bp, Artificial Sequence
  Synthetic
  modified_base (1)..(1): methylated C nucleotide
  modified_base (12)..(12): methylated C nucleotide
cgctcccagctcgccccct

SEQ ID NO: 595 - DNA, 17 bp, Artificial Sequence
  Synthetic
  modified_base (10)..(10): methylated C nucleotide
ctcccagctcgccccct

SEQ ID NO: 596 - DNA, 15 bp, Artificial Sequence
  Synthetic
  modified_base (8)..(8): methylated C nucleotide
cccagctcgccccct

SEQ ID NO: 597 - DNA, 31 bp, Artificial Sequence
  Synthetic
  modified_base (13)..(13): methylated C nucleotide
  modified_base (15)..(15): methylated C nucleotide
  modified_base (26)..(26): methylated C nucleotide
attgggagcaagcgcgctcccagctcgcccc

SEQ ID NO: 598 - DNA, 29 bp, Artificial Sequence
  Synthetic
  modified_base (13)..(13): methylated C nucleotide
  modified_base (15)..(15): methylated C nucleotide
  modified_base (26)..(26): methylated C nucleotide
attgggagcaagcgcgctcccagctcgcc

SEQ ID NO: 599 - DNA, 27 bp, Artificial Sequence
  Synthetic
  modified_base (13)..(13): methylated C nucleotide
  modified_base (15)..(15): methylated C nucleotide
  modified_base (26)..(26): methylated C nucleotide
attgggagcaagcgcgctcccagctcg

SEQ ID NO: 600 - DNA, 25 bp, Artificial Sequence
  Synthetic
  modified_base (13)..(13): methylated C nucleotide
  modified_base (15)..(15): methylated C nucleotide
attgggagcaagcgcgctcccagct

SEQ ID NO: 601 - DNA, 23 bp, Artificial Sequence
  Synthetic
  modified_base (13)..(13): methylated C nucleotide
  modified_base (15)..(15): methylated C nucleotide
attgggagcaagcgcgctcccag

SEQ ID NO: 602 - DNA, 21 bp, Artificial Sequence
  Synthetic
  modified_base (13)..(13): methylated C nucleotide
  modified_base (15)..(15): methylated C nucleotide
attgggagcaagcgcgctccc

SEQ ID NO: 603 - DNA, 19 bp, Artificial Sequence
  Synthetic
  modified_base (13)..(13): methylated C nucleotide
  modified_base (15)..(15): methylated C nucleotide
attgggagcaagcgcgctc

SEQ ID NO: 604 - DNA, 17 bp, Artificial Sequence
  Synthetic
  modified_base (13)..(13): methylated C nucleotide
  modified_base (15)..(15): methylated C nucleotide
attgggagcaagcgcgc

SEQ ID NO: 605 - DNA, 15 bp, Artificial Sequence
  Synthetic
  modified_base (13)..(13): methylated C nucleotide
  modified_base (15)..(15): methylated C nucleotide
attgggagcaagcgc

SEQ ID NO: 606 - DNA, 33 bp, Artificial Sequence
  Synthetic
  modified_base (13)..(13): methylated C nucleotide
  modified_base (15)..(15): methylated C nucleotide
  modified_base (26)..(26): methylated C nucleotide
gttgggagcaagcgcgctcccagctcgccccct

SEQ ID NO: 607 - DNA, 33 bp, Artificial Sequence
  Synthetic
  modified_base (13)..(13): methylated C nucleotide
  modified_base (15)..(15): methylated C nucleotide
  modified_base (26)..(26): methylated C nucleotide
attgggagcaagcgcgctccctgctcgccccct

SEQ ID NO: 608 - DNA, 33 bp, Artificial Sequence
  Synthetic
  modified_base (13)..(13): methylated C nucleotide
  modified_base (15)..(15): methylated C nucleotide
  modified_base (26)..(26): methylated C nucleotide
attgggagcacgcgcgctcccagctcgccccct

SEQ ID NO: 609 - DNA, 35 bp, Artificial Sequence; identical to SEQ ID NO: 37
  Synthetic
  modified_base (2)..(2): methylated C nucleotide
  modified_base (4)..(4): methylated C nucleotide
  modified_base (18)..(18): methylated C nucleotide
  modified_base (30)..(30): methylated C nucleotide
  modified_base (33)..(33): methylated C nucleotide

SEQ ID NO: 610 - DNA, 36 bp, Artificial Sequence
  Synthetic
  modified_base (3)..(3): methylated C nucleotide
  modified_base (5)..(5): methylated C nucleotide
  modified_base (19)..(19): methylated C nucleotide
  modified_base (31)..(31): methylated C nucleotide
  modified_base (34)..(34): methylated C nucleotide
ttcgcgcaggcctgggtgcgtccctcctagcgccgg

SEQ ID NO: 611 - DNA, 37 bp, Artificial Sequence
  Synthetic
  modified_base (4)..(4): methylated C nucleotide
  modified_base (6)..(6): methylated C nucleotide
  modified_base (20)..(20): methylated C nucleotide
  modified_base (32)..(32): methylated C nucleotide
  modified_base (35)..(35): methylated C nucleotide
cttcgcgcaggcctgggtgcgtccctcctagcgccgg

SEQ ID NO: 612 - DNA, 38 bp, Artificial Sequence
  Synthetic
  modified_base (5)..(5): methylated C nucleotide
  modified_base (7)..(7): methylated C nucleotide
  modified_base (21)..(21): methylated C nucleotide
  modified_base (33)..(33): methylated C nucleotide
  modified_base (36)..(36): methylated C nucleotide
tcttcgcgcaggcctgggtgcgtccctcctagcgccgg

SEQ ID NO: 613 - DNA, 39 bp, Artificial Sequence
  Synthetic
  modified_base (6)..(6): methylated C nucleotide
  modified_base (8)..(8): methylated C nucleotide
  modified_base (22)..(22): methylated C nucleotide
  modified_base (34)..(34): methylated C nucleotide
  modified_base (37)..(37): methylated C nucleotide
ctcttcgcgcaggcctgggtgcgtccctcctagcgccgg

SEQ ID NO: 614 - DNA, 40 bp, Artificial Sequence
  Synthetic
  modified_base (7)..(7): methylated C nucleotide
  modified_base (9)..(9): methylated C nucleotide
  modified_base (23)..(23): methylated C nucleotide
  modified_base (35)..(35): methylated C nucleotide
  modified_base (38)..(38): methylated C nucleotide
tctcttcgcgcaggcctgggtgcgtccctcctagcgccgg

SEQ ID NO: 615 - DNA, 36 bp, Artificial Sequence
  Synthetic
  modified_base (2)..(2): methylated C nucleotide
  modified_base (4)..(4): methylated C nucleotide
  modified_base (18)..(18): methylated C nucleotide
  modified_base (30)..(30): methylated C nucleotide
  modified_base (33)..(33): methylated C nucleotide
tcgcgcaggcctgggtgcgtccctcctagcgccggg

SEQ ID NO: 616 - DNA, 37 bp, Artificial Sequence
  Synthetic
  modified_base (2)..(2): methylated C nucleotide
  modified_base (4)..(4): methylated C nucleotide
  modified_base (18)..(18): methylated C nucleotide
  modified_base (30)..(30): methylated C nucleotide
  modified_base (33)..(33): methylated C nucleotide
tcgcgcaggcctgggtgcgtccctcctagcgccggga

SEQ ID NO: 617 - DNA, 38 bp, Artificial Sequence
  Synthetic
  modified_base (2)..(2): methylated C nucleotide
  modified_base (4)..(4): methylated C nucleotide
  modified_base (18)..(18): methylated C nucleotide
  modified_base (30)..(30): methylated C nucleotide
  modified_base (33)..(33): methylated C nucleotide
tcgcgcaggcctgggtgcgtccctcctagcgccgggaa

SEQ ID NO: 618 - DNA, 39 bp, Artificial Sequence
  Synthetic
  modified_base (2)..(2): methylated C nucleotide
  modified_base (4)..(4): methylated C nucleotide
  modified_base (18)..(18): methylated C nucleotide
  modified_base (30)..(30): methylated C nucleotide
  modified_base (33)..(33): methylated C nucleotide
tcgcgcaggcctgggtgcgtccctcctagcgccgggaag

SEQ ID NO: 619 - DNA, 40 bp, Artificial Sequence
  Synthetic
  modified_base (2)..(2): methylated C nucleotide
  modified_base (4)..(4): methylated C nucleotide
  modified_base (18)..(18): methylated C nucleotide
  modified_base (30)..(30): methylated C nucleotide
  modified_base (33)..(33): methylated C nucleotide
tcgcgcaggcctgggtgcgtccctcctagcgccgggaagc

SEQ ID NO: 620 - DNA, 37 bp, Artificial Sequence
  Synthetic
  modified_base (3)..(3): methylated C nucleotide
  modified_base (5)..(5): methylated C nucleotide
  modified_base (19)..(19): methylated C nucleotide
  modified_base (31)..(31): methylated C nucleotide
  modified_base (34)..(34): methylated C nucleotide
ttcgcgcaggcctgggtgcgtccctcctagcgccggg

SEQ ID NO: 621 - DNA, 39 bp, Artificial Sequence
  Synthetic
  modified_base (4)..(4): methylated C nucleotide
  modified_base (6)..(6): methylated C nucleotide
  modified_base (20)..(20): methylated C nucleotide
  modified_base (32)..(32): methylated C nucleotide
  modified_base (35)..(35): methylated C nucleotide
cttcgcgcaggcctgggtgcgtccctcctagcgccggga

SEQ ID NO: 622 - DNA, 41 bp, Artificial Sequence
  Synthetic
  modified_base (5)..(5): methylated C nucleotide
  modified_base (7)..(7): methylated C nucleotide
  modified_base (21)..(21): methylated C nucleotide
  modified_base (33)..(33): methylated C nucleotide
  modified_base (36)..(36): methylated C nucleotide
tcttcgcgcaggcctgggtgcgtccctcctagcgccgggaa

SEQ ID NO: 623 - DNA, 43 bp, Artificial Sequence
  Synthetic
  modified_base (6)..(6): methylated C nucleotide
  modified_base (8)..(8): methylated C nucleotide
  modified_base (22)..(22): methylated C nucleotide
  modified_base (34)..(34): methylated C nucleotide
  modified_base (37)..(37): methylated C nucleotide
ctcttcgcgcaggcctgggtgcgtccctcctagcgccgggaag

SEQ ID NO: 624 - DNA, 45 bp, Artificial Sequence
  Synthetic
  modified_base (7)..(7): methylated C nucleotide
  modified_base (9)..(9): methylated C nucleotide
  modified_base (23)..(23): methylated C nucleotide
  modified_base (35)..(35): methylated C nucleotide
  modified_base (38)..(38): methylated C nucleotide
tctcttcgcgcaggcctgggtgcgtccctcctagcgccgggaagc

SEQ ID NO: 625 - DNA, 35 bp, Artificial Sequence
  Synthetic
  modified_base (5)..(5): methylated C nucleotide
  modified_base (7)..(7): methylated C nucleotide
  modified_base (21)..(21): methylated C nucleotide
  modified_base (33)..(33): methylated C nucleotide
tcttcgcgcaggcctgggtgcgtccctcctagcgc

SEQ ID NO: 626 - DNA, 35 bp, Artificial Sequence
  Synthetic
  modified_base (8)..(8): methylated C nucleotide
  modified_base (10)..(10): methylated C nucleotide
  modified_base (24)..(24): methylated C nucleotide
ctctcttcgcgcaggcctgggtgcgtccctcctag

SEQ ID NO: 627 - DNA, 35 bp, Artificial Sequence
  Synthetic
  modified_base (11)..(11): methylated C nucleotide
  modified_base (13)..(13): methylated C nucleotide
  modified_base (27)..(27): methylated C nucleotide
tccctctcttcgcgcaggcctgggtgcgtccctcc

SEQ ID NO: 628 - DNA, 35 bp, Artificial Sequence
  Synthetic
  modified_base (14)..(14): methylated C nucleotide
  modified_base (16)..(16): methylated C nucleotide
  modified_base (30)..(30): methylated C nucleotide
ttctccctctcttcgcgcaggcctgggtgcgtccc

SEQ ID NO: 629 - DNA, 35 bp, Artificial Sequence
  Synthetic
  modified_base (17)..(17): methylated C nucleotide
  modified_base (19)..(19): methylated C nucleotide
  modified_base (33)..(33): methylated C nucleotide
actttctccctctcttcgcgcaggcctgggtgcgt

SEQ ID NO: 630 - DNA, 35 bp, Artificial Sequence
  Synthetic
  modified_base (1)..(1): methylated C nucleotide
  modified_base (15)..(15): methylated C nucleotide
  modified_base (27)..(27): methylated C nucleotide
  modified_base (30)..(30): methylated C nucleotide
cgcaggcctgggtgcgtccctcctagcgccgggaa

SEQ ID NO: 631 - DNA, 35 bp, Artificial Sequence; identical to SEQ ID NO: 456
  Synthetic
  modified_base (12)..(12): methylated C nucleotide
  modified_base (24)..(24): methylated C nucleotide
  modified_base (27)..(27): methylated C nucleotide

SEQ ID NO: 632 - DNA, 35 bp, Artificial Sequence
  Synthetic
  modified_base (9)..(9): methylated C nucleotide
  modified_base (21)..(21): methylated C nucleotide
  modified_base (24)..(24): methylated C nucleotide
cctgggtgcgtccctcctagcgccgggaagctggg

SEQ ID NO: 633 - DNA, 35 bp, Artificial Sequence
  Synthetic
  modified_base (6)..(6): methylated C nucleotide
  modified_base (18)..(18): methylated C nucleotide
  modified_base (21)..(21): methylated C nucleotide
gggtgcgtccctcctagcgccgggaagctgggttg

SEQ ID NO: 634 - DNA, 35 bp, Artificial Sequence
  Synthetic
  modified_base (3)..(3): methylated C nucleotide
  modified_base (15)..(15): methylated C nucleotide
  modified_base (18)..(18): methylated C nucleotide
tgcgtccctcctagcgccgggaagctgggttgcct

SEQ ID NO: 635 - DNA, 33 bp, Artificial Sequence
  Synthetic
  modified_base (2)..(2): methylated C nucleotide
  modified_base (16)..(16): methylated C nucleotide
  modified_base (28)..(28): methylated C nucleotide
  modified_base (31)..(31): methylated C nucleotide
gcgcaggcctgggtgcgtccctcctagcgccgg

SEQ ID NO: 636 - DNA, 31 bp, Artificial Sequence
  Synthetic
  modified_base (14)..(14): methylated C nucleotide
  modified_base (26)..(26): methylated C nucleotide
  modified_base (29)..(29): methylated C nucleotide
gcaggcctgggtgcgtccctcctagcgccgg

SEQ ID NO: 637 - DNA, 29 bp, Artificial Sequence
  Synthetic
  modified_base (12)..(12): methylated C nucleotide
  modified_base (24)..(24): methylated C nucleotide
  modified_base (27)..(27): methylated C nucleotide
aggcctgggtgcgtccctcctagcgccgg

SEQ ID NO: 638 - DNA, 27 bp, Artificial Sequence
  Synthetic
  modified_base (10)..(10): methylated C nucleotide
  modified_base (22)..(22): methylated C nucleotide
  modified_base (25)..(25): methylated C nucleotide
gcctgggtgcgtccctcctagcgccgg

SEQ ID NO: 639 - DNA, 25 bp, Artificial Sequence
  Synthetic
  modified_base (8)..(8): methylated C nucleotide
  modified_base (20)..(20): methylated C nucleotide
  modified_base (23)..(23): methylated C nucleotide
ctgggtgcgtccctcctagcgccgg

SEQ ID NO: 640 - DNA, 23 bp, Artificial Sequence
  Synthetic
  modified_base (6)..(6): methylated C nucleotide
  modified_base (18)..(18): methylated C nucleotide
  modified_base (21)..(21): methylated C nucleotide
gggtgcgtccctcctagcgccgg

SEQ ID NO: 641 - DNA, 21 bp, Artificial Sequence
  Synthetic
  modified_base (4)..(4): methylated C nucleotide
  modified_base (16)..(16): methylated C nucleotide
  modified_base (19)..(19): methylated C nucleotide
gtgcgtccctcctagcgccgg

SEQ ID NO: 642 - DNA, 19 bp, Artificial Sequence
  Synthetic
  modified_base (2)..(2): methylated C nucleotide
  modified_base (14)..(14): methylated C nucleotide
  modified_base (17)..(17): methylated C nucleotide
gcgtccctcctagcgccgg

SEQ ID NO: 643 - DNA, 17 bp, Artificial Sequence
  Synthetic
  modified_base (12)..(12): methylated C nucleotide
  modified_base (15)..(15): methylated C nucleotide
gtccctcctagcgccgg

SEQ ID NO: 644 - DNA, 15 bp, Artificial Sequence
  Synthetic
  modified_base (10)..(10): methylated C nucleotide
  modified_base (13)..(13): methylated C nucleotide
ccctcctagcgccgg

SEQ ID NO: 645 - DNA, 33 bp, Artificial Sequence
  Synthetic
  modified_base (2)..(2): methylated C nucleotide
  modified_base (4)..(4): methylated C nucleotide
  modified_base (18)..(18): methylated C nucleotide
  modified_base (30)..(30): methylated C nucleotide
  modified_base (33)..(33): methylated C nucleotide
tcgcgcaggcctgggtgcgtccctcctagcgcc

SEQ ID NO: 646 - DNA, 31 bp, Artificial Sequence
  Synthetic
  modified_base (2)..(2): methylated C nucleotide
  modified_base (4)..(4): methylated C nucleotide
  modified_base (18)..(18): methylated C nucleotide
  modified_base (30)..(30): methylated C nucleotide
tcgcgcaggcctgggtgcgtccctcctagcg

SEQ ID NO: 647 - DNA, 29 bp, Artificial Sequence
  Synthetic
  modified_base (2)..(2): methylated C nucleotide
  modified_base (4)..(4): methylated C nucleotide
  modified_base (18)..(18): methylated C nucleotide
tcgcgcaggcctgggtgcgtccctcctag

SEQ ID NO: 648 - DNA, 27 bp, Artificial Sequence
  Synthetic
  modified_base (2)..(2): methylated C nucleotide
  modified_base (4)..(4): methylated C nucleotide
  modified_base (18)..(18): methylated C nucleotide
tcgcgcaggcctgggtgcgtccctcct

SEQ ID NO: 649 - DNA, 25 bp, Artificial Sequence
  Synthetic
  modified_base (2)..(2): methylated C nucleotide
  modified_base (4)..(4): methylated C nucleotide
  modified_base (18)..(18): methylated C nucleotide
tcgcgcaggcctgggtgcgtccctc

SEQ ID NO: 650 - DNA, 23 bp, Artificial Sequence
  Synthetic
  modified_base (2)..(2): methylated C nucleotide
  modified_base (4)..(4): methylated C nucleotide
  modified_base (18)..(18): methylated C nucleotide
tcgcgcaggcctgggtgcgtccc

SEQ ID NO: 651 - DNA, 21 bp, Artificial Sequence
  Synthetic
  modified_base (2)..(2): methylated C nucleotide
  modified_base (4)..(4): methylated C nucleotide
  modified_base (18)..(18): methylated C nucleotide
tcgcgcaggcctgggtgcgtc

SEQ ID NO: 652 - DNA, 19 bp, Artificial Sequence
  Synthetic
  modified_base (2)..(2): methylated C nucleotide
  modified_base (4)..(4): methylated C nucleotide
  modified_base (18)..(18): methylated C nucleotide
tcgcgcaggcctgggtgcg

SEQ ID NO: 653 - DNA, 17 bp, Artificial Sequence
  Synthetic
  modified_base (2)..(2): methylated C nucleotide
  modified_base (4)..(4): methylated C nucleotide
tcgcgcaggcctgggtg

SEQ ID NO: 654 - DNA, 15 bp, Artificial Sequence
  Synthetic
  modified_base (2)..(2): methylated C nucleotide
  modified_base (4)..(4): methylated C nucleotide
tcgcgcaggcctggg

SEQ ID NO: 655 - DNA, 35 bp, Artificial Sequence
  Synthetic
  modified_base (2)..(2): methylated C nucleotide
  modified_base (4)..(4): methylated C nucleotide
  modified_base (18)..(18): methylated C nucleotide
  modified_base (30)..(30): methylated C nucleotide
  modified_base (33)..(33): methylated C nucleotide
tcgcacaggcctgggtgcgtccctcctagcgccgg

SEQ ID NO: 656 - DNA, 35 bp, Artificial Sequence
  Synthetic
  modified_base (2)..(2): methylated C nucleotide
  modified_base (4)..(4): methylated C nucleotide
  modified_base (18)..(18): methylated C nucleotide
  modified_base (30)..(30): methylated C nucleotide
  modified_base (33)..(33): methylated C nucleotide
tcgcgcaggcctgggtgcgcccctcctagcgccgg

SEQ ID NO: 657 - DNA, 35 bp, Artificial Sequence
  Synthetic
  modified_base (2)..(2): methylated C nucleotide
  modified_base (4)..(4): methylated C nucleotide
  modified_base (18)..(18): methylated C nucleotide
  modified_base (30)..(30): methylated C nucleotide
  modified_base (33)..(33): methylated C nucleotide
tcgcgcaggcctgggtgcgtccctccgagcgccgg

SEQ ID NO: 658 - DNA, 34 bp, Artificial Sequence; identical to SEQ ID NO: 38
  Synthetic
  modified_base (2)..(2): methylated C nucleotide
  modified_base (4)..(4): methylated C nucleotide
  modified_base (17)..(17): methylated C nucleotide
  modified_base (29)..(29): methylated C nucleotide
  modified_base (32)..(32): methylated C nucleotide

SEQ ID NO: 659 - DNA, 35 bp, Artificial Sequence
  Synthetic
  modified_base (3)..(3): methylated C nucleotide
  modified_base (5)..(5): methylated C nucleotide
  modified_base (18)..(18): methylated C nucleotide
  modified_base (30)..(30): methylated C nucleotide
  modified_base (33)..(33): methylated C nucleotide
ttcgcgcaggcctgggtcgtccctcctagcgccgg

SEQ ID NO: 660 - DNA, 36 bp, Artificial Sequence
  Synthetic
  modified_base (4)..(4): methylated C nucleotide
  modified_base (6)..(6): methylated C nucleotide
  modified_base (19)..(19): methylated C nucleotide
  modified_base (31)..(31): methylated C nucleotide
  modified_base (34)..(34): methylated C nucleotide
cttcgcgcaggcctgggtcgtccctcctagcgccgg

SEQ ID NO: 661 - DNA, 37 bp, Artificial Sequence
  Synthetic
  modified_base (5)..(5): methylated C nucleotide
  modified_base (7)..(7): methylated C nucleotide
  modified_base (20)..(20): methylated C nucleotide
  modified_base (32)..(32): methylated C nucleotide
  modified_base (35)..(35): methylated C nucleotide
tcttcgcgcaggcctgggtcgtccctcctagcgccgg

SEQ ID NO: 662 - DNA, 38 bp, Artificial Sequence
  Synthetic
  modified_base (6)..(6): methylated C nucleotide
  modified_base (8)..(8): methylated C nucleotide
  modified_base (21)..(21): methylated C nucleotide
  modified_base (33)..(33): methylated C nucleotide
  modified_base (36)..(36): methylated C nucleotide
ctcttcgcgcaggcctgggtcgtccctcctagcgccgg

SEQ ID NO: 663 - DNA, 39 bp, Artificial Sequence
  Synthetic
  modified_base (7)..(7): methylated C nucleotide
  modified_base (9)..(9): methylated C nucleotide
  modified_base (22)..(22): methylated C nucleotide
  modified_base (34)..(34): methylated C nucleotide
  modified_base (37)..(37): methylated C nucleotide
tctcttcgcgcaggcctgggtcgtccctcctagcgccgg

SEQ ID NO: 664 - DNA, 35 bp, Artificial Sequence
  Synthetic
  modified_base (2)..(2): methylated C nucleotide
  modified_base (4)..(4): methylated C nucleotide
  modified_base (17)..(17): methylated C nucleotide
  modified_base (29)..(29): methylated C nucleotide
  modified_base (32)..(32): methylated C nucleotide
tcgcgcaggcctgggtcgtccctcctagcgccggg

SEQ ID NO: 665 - DNA, 36 bp, Artificial Sequence
  Synthetic
  modified_base (2)..(2): methylated C nucleotide
  modified_base (4)..(4): methylated C nucleotide
  modified_base (17)..(17): methylated C nucleotide
  modified_base (29)..(29): methylated C nucleotide
  modified_base (32)..(32): methylated C nucleotide
tcgcgcaggcctgggtcgtccctcctagcgccggga

SEQ ID NO: 666 - DNA, 37 bp, Artificial Sequence
  Synthetic
  modified_base (2)..(2): methylated C nucleotide
  modified_base (4)..(4): methylated C nucleotide
  modified_base (17)..(17): methylated C nucleotide
  modified_base (29)..(29): methylated C nucleotide
  modified_base (32)..(32): methylated C nucleotide
tcgcgcaggcctgggtcgtccctcctagcgccgggaa

SEQ ID NO: 667 - DNA, 38 bp, Artificial Sequence
  Synthetic
  modified_base (2)..(2): methylated C nucleotide
  modified_base (4)..(4): methylated C nucleotide
  modified_base (17)..(17): methylated C nucleotide
  modified_base (29)..(29): methylated C nucleotide
  modified_base (32)..(32): methylated C nucleotide
tcgcgcaggcctgggtcgtccctcctagcgccgggaag

SEQ ID NO: 668 - DNA, 39 bp, Artificial Sequence
  Synthetic
  modified_base (2)..(2): methylated C nucleotide
  modified_base (4)..(4): methylated C nucleotide
  modified_base (17)..(17): methylated C nucleotide
  modified_base (29)..(29): methylated C nucleotide
  modified_base (32)..(32): methylated C nucleotide
tcgcgcaggcctgggtcgtccctcctagcgccgggaagc

SEQ ID NO: 669 - DNA, 36 bp, Artificial Sequence
  Synthetic
  modified_base (3)..(3): methylated C nucleotide
  modified_base (5)..(5): methylated C nucleotide
  modified_base (18)..(18): methylated C nucleotide
  modified_base (30)..(30): methylated C nucleotide
  modified_base (33)..(33): methylated C nucleotide
ttcgcgcaggcctgggtcgtccctcctagcgccggg

SEQ ID NO: 670 - DNA, 38 bp, Artificial Sequence
  Synthetic
  modified_base (4)..(4): methylated C nucleotide
  modified_base (6)..(6): methylated C nucleotide
  modified_base (19)..(19): methylated C nucleotide
  modified_base (31)..(31): methylated C nucleotide
  modified_base (34)..(34): methylated C nucleotide
cttcgcgcaggcctgggtcgtccctcctagcgccggga

SEQ ID NO: 671 - DNA, 40 bp, Artificial Sequence
  Synthetic
  modified_base (5)..(5): methylated C nucleotide
  modified_base (7)..(7): methylated C nucleotide
  modified_base (20)..(20): methylated C nucleotide
  modified_base (32)..(32): methylated C nucleotide
  modified_base (35)..(35): methylated C nucleotide
tcttcgcgcaggcctgggtcgtccctcctagcgccgggaa

SEQ ID NO: 672 - DNA, 42 bp, Artificial Sequence
  Synthetic
  modified_base (6)..(6): methylated C nucleotide
  modified_base (8)..(8): methylated C nucleotide
  modified_base (21)..(21): methylated C nucleotide
  modified_base (33)..(33): methylated C nucleotide
  modified_base (36)..(36): methylated C nucleotide
ctcttcgcgcaggcctgggtcgtccctcctagcgccgggaag

SEQ ID NO: 673 - DNA, 44 bp, Artificial Sequence
  Synthetic
  modified_base (7)..(7): methylated C nucleotide
  modified_base (9)..(9): methylated C nucleotide
  modified_base (22)..(22): methylated C nucleotide
  modified_base (34)..(34): methylated C nucleotide
  modified_base (37)..(37): methylated C nucleotide
tctcttcgcgcaggcctgggtcgtccctcctagcgccgggaagc

SEQ ID NO: 674 - DNA, 34 bp, Artificial Sequence
  Synthetic
  modified_base (5)..(5): methylated C nucleotide
  modified_base (7)..(7): methylated C nucleotide
  modified_base (20)..(20): methylated C nucleotide
  modified_base (32)..(32): methylated C nucleotide
tcttcgcgcaggcctgggtcgtccctcctagcgc

SEQ ID NO: 675 - DNA, 34 bp, Artificial Sequence
  Synthetic
  modified_base (8)..(8): methylated C nucleotide
  modified_base (10)..(10): methylated C nucleotide
  modified_base (23)..(23): methylated C nucleotide
ctctcttcgcgcaggcctgggtcgtccctcctag

SEQ ID NO: 676 - DNA, 34 bp, Artificial Sequence
  Synthetic
  modified_base (11)..(11): methylated C nucleotide
  modified_base (13)..(13): methylated C nucleotide
  modified_base (26)..(26): methylated C nucleotide
tccctctcttcgcgcaggcctgggtcgtccctcc

SEQ ID NO: 677 - DNA, 34 bp, Artificial Sequence
  Synthetic
  modified_base (14)..(14): methylated C nucleotide
  modified_base (16)..(16): methylated C nucleotide
  modified_base (29)..(29): methylated C nucleotide
ttctccctctcttcgcgcaggcctgggtcgtccc

SEQ ID NO: 678 - DNA, 34 bp, Artificial Sequence
  Synthetic
  modified_base (17)..(17): methylated C nucleotide
  modified_base (19)..(19): methylated C nucleotide
  modified_base (32)..(32): methylated C nucleotide
actttctccctctcttcgcgcaggcctgggtcgt

SEQ ID NO: 679 - DNA, 34 bp, Artificial Sequence
  Synthetic
  modified_base (1)..(1): methylated C nucleotide
  modified_base (14)..(14): methylated C nucleotide
  modified_base (26)..(26): methylated C nucleotide
  modified_base (29)..(29): methylated C nucleotide
cgcaggcctgggtcgtccctcctagcgccgggaa

SEQ ID NO: 680 - DNA, 34 bp, Artificial Sequence
  Synthetic
  modified_base (11)..(11): methylated C nucleotide
  modified_base (23)..(23): methylated C nucleotide
  modified_base (26)..(26): methylated C nucleotide
aggcctgggtcgtccctcctagcgccgggaagct

SEQ ID NO: 681 - DNA, 34 bp, Artificial Sequence
  Synthetic
  modified_base (8)..(8): methylated C nucleotide
  modified_base (20)..(20): methylated C nucleotide
  modified_base (23)..(23): methylated C nucleotide
cctgggtcgtccctcctagcgccgggaagctggg

SEQ ID NO: 682 - DNA, 34 bp, Artificial Sequence
  Synthetic
  modified_base (5)..(5): methylated C nucleotide
  modified_base (17)..(17): methylated C nucleotide
  modified_base (20)..(20): methylated C nucleotide
gggtcgtccctcctagcgccgggaagctgggttg

SEQ ID NO: 683 - DNA, 34 bp, Artificial Sequence
  Synthetic
  modified_base (2)..(2): methylated C nucleotide
  modified_base (14)..(14): methylated C nucleotide
  modified_base (17)..(17): methylated C nucleotide
tcgtccctcctagcgccgggaagctgggttgcct

SEQ ID NO: 684 - DNA, 32 bp, Artificial Sequence
  Synthetic
  modified_base (2)..(2): methylated C nucleotide
  modified_base (15)..(15): methylated C nucleotide
  modified_base (27)..(27): methylated C nucleotide
  modified_base (30)..(30): methylated C nucleotide
gcgcaggcctgggtcgtccctcctagcgccgg

SEQ ID NO: 685 - DNA, 30 bp, Artificial Sequence
  Synthetic
  modified_base (13)..(13): methylated C nucleotide
  modified_base (25)..(25): methylated C nucleotide
  modified_base (28)..(28): methylated C nucleotide
gcaggcctgggtcgtccctcctagcgccgg

SEQ ID NO: 686 - DNA, 28 bp, Artificial Sequence
  Synthetic
  modified_base (11)..(11): methylated C nucleotide
  modified_base (23)..(23): methylated C nucleotide
  modified_base (26)..(26): methylated C nucleotide
aggcctgggtcgtccctcctagcgccgg

SEQ ID NO: 687 - DNA, 26 bp, Artificial Sequence
  Synthetic
  modified_base (9)..(9): methylated C nucleotide
  modified_base (21)..(21): methylated C nucleotide
  modified_base (24)..(24): methylated C nucleotide
gcctgggtcgtccctcctagcgccgg

SEQ ID NO: 688 - DNA, 24 bp, Artificial Sequence
  Synthetic
  modified_base (7)..(7): methylated C nucleotide
  modified_base (19)..(19): methylated C nucleotide
  modified_base (22)..(22): methylated C nucleotide
ctgggtcgtccctcctagcgccgg

SEQ ID NO: 689 - DNA, 22 bp, Artificial Sequence
  Synthetic
  modified_base (5)..(5): methylated C nucleotide
  modified_base (17)..(17): methylated C nucleotide
  modified_base (20)..(20): methylated C nucleotide
gggtcgtccctcctagcgccgg

SEQ ID NO: 690 - DNA, 20 bp, Artificial Sequence
  Synthetic
  modified_base (3)..(3): methylated C nucleotide
  modified_base (15)..(15): methylated C nucleotide
  modified_base (18)..(18): methylated C nucleotide
gtcgtccctcctagcgccgg

SEQ ID NO: 691 - DNA, 18 bp, Artificial Sequence
  Synthetic
  modified_base (1)..(1): methylated C nucleotide
  modified_base (13)..(13): methylated C nucleotide
  modified_base (16)..(16): methylated C nucleotide
cgtccctcctagcgccgg

SEQ ID NO: 692 - DNA, 16 bp, Artificial Sequence
  Synthetic
  modified_base (11)..(11): methylated C nucleotide
  modified_base (14)..(14): methylated C nucleotide
tccctcctagcgccgg

SEQ ID NO: 693 - DNA, 15 bp, Artificial Sequence
  Synthetic
  modified_base (10)..(10): methylated C nucleotide
  modified_base (13)..(13): methylated C nucleotide
ccctcctagcgccgg

SEQ ID NO: 694 - DNA, 32 bp, Artificial Sequence
  Synthetic
  modified_base (2)..(2): methylated C nucleotide
  modified_base (4)..(4): methylated C nucleotide
  modified_base (17)..(17): methylated C nucleotide
  modified_base (29)..(29): methylated C nucleotide
  modified_base (32)..(32): methylated C nucleotide
tcgcgcaggcctgggtcgtccctcctagcgcc

SEQ ID NO: 695 - DNA, 30 bp, Artificial Sequence
  Synthetic
  modified_base (2)..(2): methylated C nucleotide
  modified_base (4)..(4): methylated C nucleotide
  modified_base (17)..(17): methylated C nucleotide
  modified_base (29)..(29): methylated C nucleotide
tcgcgcaggcctgggtcgtccctcctagcg

SEQ ID NO: 696 - DNA, 28 bp, Artificial Sequence
  Synthetic
  modified_base (2)..(2): methylated C nucleotide
  modified_base (4)..(4): methylated C nucleotide
  modified_base (17)..(17): methylated C nucleotide
tcgcgcaggcctgggtcgtccctcctag

SEQ ID NO: 697 - DNA, 26 bp, Artificial Sequence
  Synthetic
  modified_base (2)..(2): methylated C nucleotide
  modified_base (4)..(4): methylated C nucleotide
  modified_base (17)..(17): methylated C nucleotide
tcgcgcaggcctgggtcgtccctcct

SEQ ID NO: 698 - DNA, 24 bp, Artificial Sequence
  Synthetic
  modified_base (2)..(2): methylated C nucleotide
  modified_base (4)..(4): methylated C nucleotide
  modified_base (17)..(17): methylated C nucleotide
tcgcgcaggcctgggtcgtccctc

SEQ ID NO: 699 - DNA, 22 bp, Artificial Sequence
  Synthetic
  modified_base (2)..(2): methylated C nucleotide
  modified_base (4)..(4): methylated C nucleotide
  modified_base (17)..(17): methylated C nucleotide
tcgcgcaggcctgggtcgtccc

SEQ ID NO: 700 - DNA, 20 bp, Artificial Sequence
  Synthetic
  modified_base (2)..(2): methylated C nucleotide
  modified_base (4)..(4): methylated C nucleotide
  modified_base (17)..(17): methylated C nucleotide
tcgcgcaggcctgggtcgtc

SEQ ID NO: 701 - DNA, 18 bp, Artificial Sequence
  Synthetic
  modified_base (2)..(2): methylated C nucleotide
  modified_base (4)..(4): methylated C nucleotide
  modified_base (17)..(17): methylated C nucleotide
tcgcgcaggcctgggtcg

SEQ ID NO: 702 - DNA, 16 bp, Artificial Sequence
  Synthetic
  modified_base (2)..(2): methylated C nucleotide
  modified_base (4)..(4): methylated C nucleotide
tcgcgcaggcctgggt

SEQ ID NO: 703 - DNA, 15 bp, Artificial Sequence
  Synthetic
  modified_base (2)..(2): methylated C nucleotide
  modified_base (4)..(4): methylated C nucleotide
tcgcgcaggcctggg

SEQ ID NO: 704 - DNA, 34 bp, Artificial Sequence
  Synthetic
  modified_base (2)..(2): methylated C nucleotide
  modified_base (4)..(4): methylated C nucleotide
  modified_base (17)..(17): methylated C nucleotide
  modified_base (29)..(29): methylated C nucleotide
  modified_base (32)..(32): methylated C nucleotide
tcgcacaggcctgggtcgtccctcctagcgccgg

SEQ ID NO: 705 - DNA, 34 bp, Artificial Sequence
  Synthetic
  modified_base (2)..(2): methylated C nucleotide
  modified_base (4)..(4): methylated C nucleotide
  modified_base (17)..(17): methylated C nucleotide
  modified_base (29)..(29): methylated C nucleotide
  modified_base (32)..(32): methylated C nucleotide
tcgcgcaggcctgggtcgttcctcctagcgccgg

SEQ ID NO: 706 - DNA, 34 bp, Artificial Sequence
  Synthetic
  modified_base (2)..(2): methylated C nucleotide
  modified_base (4)..(4): methylated C nucleotide
  modified_base (17)..(17): methylated C nucleotide
  modified_base (29)..(29): methylated C nucleotide
  modified_base (32)..(32): methylated C nucleotide
tcgcgcaggcctgggtcgtccctccgagcgccgg

SEQ ID NO: 707 - DNA, 23 bp, Artificial Sequence
  Synthetic
  modified_base (3)..(3): methylated C nucleotide
  modified_base (8)..(8): methylated C nucleotide
  modified_base (14)..(14): methylated C nucleotide
  modified_base (19)..(19): methylated C nucleotide
  modified_base (21)..(21): methylated C nucleotide
cccggagcgggaccggaccgcgg

SEQ ID NO: 708 - DNA, 24 bp, Artificial Sequence
  Synthetic
  modified_base (4)..(4): methylated C nucleotide
  modified_base (9)..(9): methylated C nucleotide
  modified_base (15)..(15): methylated C nucleotide
  modified_base (20)..(20): methylated C nucleotide
  modified_base (22)..(22): methylated C nucleotide
acccggagcgggaccggaccgcgg

SEQ ID NO: 709 - DNA, 25 bp, Artificial Sequence
  Synthetic
  modified_base (5)..(5): methylated C nucleotide
  modified_base (10)..(10): methylated C nucleotide
  modified_base (16)..(16): methylated C nucleotide
  modified_base (21)..(21): methylated C nucleotide
  modified_base (23)..(23): methylated C nucleotide
gacccggagcgggaccggaccgcgg

SEQ ID NO: 710 - DNA, 26 bp, Artificial Sequence
  Synthetic
  modified_base (6)..(6): methylated C nucleotide
  modified_base (11)..(11): methylated C nucleotide
  modified_base (17)..(17): methylated C nucleotide
  modified_base (22)..(22): methylated C nucleotide
  modified_base (24)..(24): methylated C nucleotide
tgacccggagcgggaccggaccgcgg

SEQ ID NO: 711 - DNA, 27 bp, Artificial Sequence
  Synthetic
  modified_base (7)..(7): methylated C nucleotide
  modified_base (12)..(12): methylated C nucleotide
  modified_base (18)..(18): methylated C nucleotide
  modified_base (23)..(23): methylated C nucleotide
  modified_base (25)..(25): methylated C nucleotide
ctgacccggagcgggaccggaccgcgg

SEQ ID NO: 712 - DNA, 28 bp, Artificial Sequence
  Synthetic
  modified_base (8)..(8): methylated C nucleotide
  modified_base (13)..(13): methylated C nucleotide
  modified_base (19)..(19): methylated C nucleotide
  modified_base (24)..(24): methylated C nucleotide
  modified_base (26)..(26): methylated C nucleotide
tctgacccggagcgggaccggaccgcgg

SEQ ID NO: 713 - DNA, 24 bp, Artificial Sequence
  Synthetic
  modified_base (3)..(3): methylated C nucleotide
  modified_base (8)..(8): methylated C nucleotide
  modified_base (14)..(14): methylated C nucleotide
  modified_base (19)..(19): methylated C nucleotide
  modified_base (21)..(21): methylated C nucleotide
cccggagcgggaccggaccgcggc

SEQ ID NO: 714 - DNA, 25 bp, Artificial Sequence
  Synthetic
  modified_base (3)..(3): methylated C nucleotide
  modified_base (8)..(8): methylated C nucleotide
  modified_base (14)..(14): methylated C nucleotide
  modified_base (19)..(19): methylated C nucleotide
  modified_base (21)..(21): methylated C nucleotide
cccggagcgggaccggaccgcggcg

SEQ ID NO: 715 - DNA, 26 bp, Artificial Sequence
  Synthetic
  modified_base (3)..(3): methylated C nucleotide
  modified_base (8)..(8): methylated C nucleotide
  modified_base (14)..(14): methylated C nucleotide
  modified_base (19)..(19): methylated C nucleotide
  modified_base (21)..(21): methylated C nucleotide
cccggagcgggaccggaccgcggcgg

SEQ ID NO: 716 - DNA, 27 bp, Artificial Sequence
  Synthetic
  modified_base (3)..(3): methylated C nucleotide
  modified_base (8)..(8): methylated C nucleotide
  modified_base (14)..(14): methylated C nucleotide
  modified_base (19)..(19): methylated C nucleotide
  modified_base (21)..(21): methylated C nucleotide
cccggagcgggaccggaccgcggcggg

SEQ ID NO: 717 - DNA, 28 bp, Artificial Sequence
  Synthetic
  modified_base (3)..(3): methylated C nucleotide
  modified_base (8)..(8): methylated C nucleotide
  modified_base (14)..(14): methylated C nucleotide
  modified_base (19)..(19): methylated C nucleotide
  modified_base (21)..(21): methylated C nucleotide
cccggagcgggaccggaccgcggcgggc

SEQ ID NO: 718 - DNA, 25 bp, Artificial Sequence
  Synthetic
  modified_base (4)..(4): methylated C nucleotide
  modified_base (9)..(9): methylated C nucleotide
  modified_base (15)..(15): methylated C nucleotide
  modified_base (20)..(20): methylated C nucleotide
  modified_base (22)..(22): methylated C nucleotide
acccggagcgggaccggaccgcggc

SEQ ID NO: 719 - DNA, 27 bp, Artificial Sequence
  Synthetic
  modified_base (5)..(5): methylated C nucleotide
  modified_base (10)..(10): methylated C nucleotide
  modified_base (16)..(16): methylated C nucleotide
  modified_base (21)..(21): methylated C nucleotide
  modified_base (23)..(23): methylated C nucleotide
gacccggagcgggaccggaccgcggcg

SEQ ID NO: 720 - DNA, 29 bp, Artificial Sequence
  Synthetic
  modified_base (6)..(6): methylated C nucleotide
  modified_base (11)..(11): methylated C nucleotide
  modified_base (17)..(17): methylated C nucleotide
  modified_base (22)..(22): methylated C nucleotide
  modified_base (24)..(24): methylated C nucleotide
tgacccggagcgggaccggaccgcggcgg

SEQ ID NO: 721 - DNA, 31 bp, Artificial Sequence
  Synthetic
  modified_base (7)..(7): methylated C nucleotide
  modified_base (12)..(12): methylated C nucleotide
  modified_base (18)..(18): methylated C nucleotide
  modified_base (23)..(23): methylated C nucleotide
  modified_base (25)..(25): methylated C nucleotide
ctgacccggagcgggaccggaccgcggcggg

SEQ ID NO: 722 - DNA, 33 bp, Artificial Sequence
  Synthetic
  modified_base (8)..(8): methylated C nucleotide
  modified_base (13)..(13): methylated C nucleotide
  modified_base (19)..(19): methylated C nucleotide
  modified_base (24)..(24)
  modified_base (26)..(26)
tctgacccggagcgggaccggaccgcggcgggc

SEQ ID NO: 723 - DNA, 23 bp, Artificial Sequence
  Synthetic
  modified_base (6)..(6): methylated C nucleotide
  modified_base (11)..(11): methylated C nucleotide
  modified_base (17)..(17): methylated C nucleotide
  modified_base (22)..(22): methylated C nucleotide
tgacccggagcgggaccggaccg

SEQ ID NO: 724 - DNA, 23 bp, Artificial Sequence
  Synthetic
  modified_base (9)..(9): methylated C nucleotide
  modified_base (14)..(14): methylated C nucleotide
  modified_base (20)..(20): methylated C nucleotide
ttctgacccggagcgggaccgga

SEQ ID NO: 725 - DNA, 23 bp, Artificial Sequence
  Synthetic
  modified_base (12)..(12): methylated C nucleotide
  modified_base (17)..(17): methylated C nucleotide
  modified_base (23)..(23): methylated C nucleotide
caattctgacccggagcgggacc

SEQ ID NO: 726 - DNA, 23 bp, Artificial Sequence
  Synthetic
  modified_base (15)..(15): methylated C nucleotide
  modified_base (20)..(20): methylated C nucleotide
cgccaattctgacccggagcggg

SEQ ID NO: 727 - DNA, 23 bp, Artificial Sequence
  Synthetic
  modified_base (18)..(18): methylated C nucleotide
  modified_base (23)..(23): methylated C nucleotide
agccgccaattctgacccggagc

SEQ ID NO: 728 - DNA, 23 bp, Artificial Sequence
  Synthetic
  modified_base (5)..(5): methylated C nucleotide
  modified_base (11)..(11): methylated C nucleotide
  modified_base (16)..(16): methylated C nucleotide
  modified_base (18)..(18): methylated C nucleotide
ggagcgggaccggaccgcggcgg

SEQ ID NO: 729 - DNA, 23 bp, Artificial Sequence
  Synthetic
  modified_base (2)..(2): methylated C nucleotide
  modified_base (8)..(8): methylated C nucleotide
  modified_base (13)..(13): methylated C nucleotide
  modified_base (15)..(15): methylated C nucleotide
gcgggaccggaccgcggcgggct

SEQ ID NO: 730 - DNA, 23 bp, Artificial Sequence
  Synthetic
  modified_base (5)..(5): methylated C nucleotide
  modified_base (10)..(10): methylated C nucleotide
  modified_base (12)..(12): methylated C nucleotide
ggaccggaccgcggcgggctgtg

SEQ ID NO: 731 - DNA, 23 bp, Artificial Sequence
  Synthetic
  modified_base (2)..(2): methylated C nucleotide
  modified_base (7)..(7): methylated C nucleotide
  modified_base (9)..(9): methylated C nucleotide
ccggaccgcggcgggctgtgcgg

SEQ ID NO: 732 - DNA, 23 bp, Artificial Sequence
  Synthetic
  modified_base (4)..(4): methylated C nucleotide
  modified_base (6)..(6): methylated C nucleotide
gaccgcggcgggctgtgcggatg

SEQ ID NO: 733 - DNA, 21 bp, Artificial Sequence
  Synthetic
  modified_base (1)..(1): methylated C nucleotide
  modified_base (6)..(6): methylated C nucleotide
  modified_base (12)..(12): methylated C nucleotide
  modified_base (17)..(17): methylated C nucleotide
  modified_base (19)..(19): methylated C nucleotide
cggagcgggaccggaccgcgg

SEQ ID NO: 734 - DNA, 19 bp, Artificial Sequence
  Synthetic
  modified_base (4)..(4): methylated C nucleotide
  modified_base (10)..(10): methylated C nucleotide
  modified_base (15)..(15): methylated C nucleotide
  modified_base (17)..(17): methylated C nucleotide
gagcgggaccggaccgcgg

SEQ ID NO: 735 - DNA, 17 bp, Artificial Sequence
  Synthetic
  modified_base (2)..(2): methylated C nucleotide
  modified_base (8)..(8): methylated C nucleotide
  modified_base (13)..(13): methylated C nucleotide
  modified_base (15)..(15): methylated C nucleotide
gcgggaccggaccgcgg

SEQ ID NO: 736 - DNA, 15 bp, Artificial Sequence
  Synthetic
  modified_base (6)..(6): methylated C nucleotide
  modified_base (11)..(11): methylated C nucleotide
  modified_base (13)..(13): methylated C nucleotide
gggaccggaccgcgg

SEQ ID NO: 737 - DNA, 21 bp, Artificial Sequence
  Synthetic
  modified_base (3)..(3): methylated C nucleotide
  modified_base (8)..(8): methylated C nucleotide
  modified_base (14)..(14): methylated C nucleotide
  modified_base (19)..(19): methylated C nucleotide
  modified_base (21)..(21): methylated C nucleotide
cccggagcgggaccggaccgc

SEQ ID NO: 738 - DNA, 19 bp, Artificial Sequence
  Synthetic
  modified_base (3)..(3): methylated C nucleotide
  modified_base (8)..(8): methylated C nucleotide
  modified_base (14)..(14): methylated C nucleotide
  modified_base (19)..(19): methylated C nucleotide
cccggagcgggaccggacc

SEQ ID NO: 739 - DNA, 17 bp, Artificial Sequence
  Synthetic
  modified_base (3)..(3): methylated C nucleotide
  modified_base (8)..(8): methylated C nucleotide
  modified_base (14)..(14): methylated C nucleotide
cccggagcgggaccgga

SEQ ID NO: 740 - DNA, 15 bp, Artificial Sequence
  Synthetic
  modified_base (3)..(3): methylated C nucleotide
  modified_base (8)..(8): methylated C nucleotide
  modified_base (14)..(14): methylated C nucleotide
cccggagcgggaccg

SEQ ID NO: 741 - DNA, 23 bp, Artificial Sequence
  Synthetic
  modified_base (3)..(3): methylated C nucleotide
  modified_base (8)..(8): methylated C nucleotide
  modified_base (14)..(14): methylated C nucleotide
  modified_base (19)..(19): methylated C nucleotide
  modified_base (21)..(21): methylated C nucleotide
cccggagccggaccggaccgcgg

SEQ ID NO: 742 - DNA, 23 bp, Artificial Sequence
  Synthetic
  modified_base (3)..(3): methylated C nucleotide
  modified_base (8)..(8): methylated C nucleotide
  modified_base (14)..(14): methylated C nucleotide
  modified_base (19)..(19): methylated C nucleotide
  modified_base (21)..(21): methylated C nucleotide
cccggagcgggaccggaccacgg

SEQ ID NO: 743 - DNA, 23 bp, Artificial Sequence
  Synthetic
  modified_base (3)..(3): methylated C nucleotide
  modified_base (8)..(8): methylated C nucleotide
  modified_base (14)..(14): methylated C nucleotide
  modified_base (19)..(19): methylated C nucleotide
  modified_base (21)..(21): methylated C nucleotide
ccctgagcgggaccggaccgcgg

SEQ ID NO: 744 - DNA, 24 bp, Artificial Sequence
  Synthetic
  modified_base (3)..(3): methylated C nucleotide
  modified_base (11)..(11): methylated C nucleotide
  modified_base (13)..(13): methylated C nucleotide
  modified_base (16)..(16): methylated C nucleotide
  modified_base (21)..(21): methylated C nucleotide
gccggacccacgcggcggcccgcc

SEQ ID NO: 745 - DNA, 25 bp, Artificial Sequence
  Synthetic
  modified_base (4)..(4): methylated C nucleotide
  modified_base (12)..(12): methylated C nucleotide
  modified_base (14)..(14): methylated C nucleotide
  modified_base (17)..(17): methylated C nucleotide
  modified_base (22)..(22): methylated C nucleotide
tgccggacccacgcggcggcccgcc

SEQ ID NO: 746 - DNA, 26 bp, Artificial Sequence
  Synthetic
  modified_base (5)..(5): methylated C nucleotide
  modified_base (13)..(13): methylated C nucleotide
  modified_base (15)..(15): methylated C nucleotide
  modified_base (18)..(18): methylated C nucleotide
  modified_base (23)..(23): methylated C nucleotide
ctgccggacccacgcggcggcccgcc

SEQ ID NO: 747 - DNA, 27 bp, Artificial Sequence
  Synthetic
  modified_base (6)..(6): methylated C nucleotide
  modified_base (14)..(14): methylated C nucleotide
  modified_base (16)..(16): methylated C nucleotide
  modified_base (19)..(19): methylated C nucleotide
  modified_base (24)..(24): methylated C nucleotide
actgccggacccacgcggcggcccgcc

SEQ ID NO: 748 - DNA, 28 bp, Artificial Sequence
  Synthetic
  modified_base (7)..(7): methylated C nucleotide
  modified_base (15)..(15): methylated C nucleotide
  modified_base (17)..(17): methylated C nucleotide
  modified_base (20)..(20): methylated C nucleotide
  modified_base (25)..(25): methylated C nucleotide
gactgccggacccacgcggcggcccgcc

SEQ ID NO: 749 - DNA, 29 bp, Artificial Sequence
  Synthetic
  modified_base (8)..(8): methylated C nucleotide
  modified_base (16)..(16): methylated C nucleotide
  modified_base (18)..(18): methylated C nucleotide
  modified_base (21)..(21): methylated C nucleotide
  modified_base (26)..(26): methylated C nucleotide
ggactgccggacccacgcggcggcccgcc

SEQ ID NO: 750 - DNA, 25 bp, Artificial Sequence
  Synthetic
  modified_base (3)..(3): methylated C nucleotide
  modified_base (11)..(11): methylated C nucleotide
  modified_base (13)..(13): methylated C nucleotide
  modified_base (16)..(16): methylated C nucleotide
  modified_base (21)..(21): methylated C nucleotide
gccggacccacgcggcggcccgccc

SEQ ID NO: 751 - DNA, 26 bp, Artificial Sequence
  Synthetic
  modified_base (3)..(3): methylated C nucleotide
  modified_base (11)..(11): methylated C nucleotide
  modified_base (13)..(13): methylated C nucleotide
  modified_base (16)..(16): methylated C nucleotide
  modified_base (21)..(21): methylated C nucleotide
gccggacccacgcggcggcccgcccc

SEQ ID NO: 752 - DNA, 27 bp, Artificial Sequence
  Synthetic
  modified_base (3)..(3): methylated C nucleotide
  modified_base (11)..(11): methylated C nucleotide
  modified_base (13)..(13): methylated C nucleotide
  modified_base (16)..(16): methylated C nucleotide
  modified_base (21)..(21): methylated C nucleotide
gccggacccacgcggcggcccgccccc

SEQ ID NO: 753 - DNA, 28 bp, Artificial Sequence
  Synthetic
  modified_base (3)..(3): methylated C nucleotide
  modified_base (11)..(11): methylated C nucleotide
  modified_base (13)..(13): methylated C nucleotide
  modified_base (16)..(16): methylated C nucleotide
  modified_base (21)..(21): methylated C nucleotide
gccggacccacgcggcggcccgccccct

SEQ ID NO: 754 - DNA, 29 bp, Artificial Sequence
  Synthetic
  modified_base (3)..(3): methylated C nucleotide
  modified_base (11)..(11): methylated C nucleotide
  modified_base (13)..(13): methylated C nucleotide
  modified_base (16)..(16): methylated C nucleotide
  modified_base (21)..(21): methylated C nucleotide
gccggacccacgcggcggcccgccccctg

SEQ ID NO: 755 - DNA, 26 bp, Artificial Sequence
  Synthetic
  modified_base (4)..(4): methylated C nucleotide
  modified_base (12)..(12): methylated C nucleotide
  modified_base (14)..(14): methylated C nucleotide
  modified_base (17)..(17): methylated C nucleotide
  modified_base (22)..(22): methylated C nucleotide
tgccggacccacgcggcggcccgccc

SEQ ID NO: 756 - DNA, 28 bp, Artificial Sequence
  Synthetic
  modified_base (5)..(5): methylated C nucleotide
  modified_base (13)..(13): methylated C nucleotide
  modified_base (15)..(15): methylated C nucleotide
  modified_base (18)..(18): methylated C nucleotide
  modified_base (23)..(23): methylated C nucleotide
ctgccggacccacgcggcggcccgcccc

SEQ ID NO: 757 - DNA, 30 bp, Artificial Sequence
  Synthetic
  modified_base (6)..(6): methylated C nucleotide
  modified_base (14)..(14): methylated C nucleotide
  modified_base (16)..(16): methylated C nucleotide
  modified_base (19)..(19): methylated C nucleotide
  modified_base (24)..(24): methylated C nucleotide
actgccggacccacgcggcggcccgccccc

SEQ ID NO: 758 - DNA, 32 bp, Artificial Sequence
  Synthetic
  modified_base (7)..(7): methylated C nucleotide
  modified_base (15)..(15): methylated C nucleotide
  modified_base (17)..(17): methylated C nucleotide
  modified_base (20)..(20): methylated C nucleotide
  modified_base (25)..(25): methylated C nucleotide
gactgccggacccacgcggcggcccgccccct

SEQ ID NO: 759 - DNA, 34 bp, Artificial Sequence
  Synthetic
  modified_base (8)..(8): methylated C nucleotide
  modified_base (16)..(16): methylated C nucleotide
  modified_base (18)..(18): methylated C nucleotide
  modified_base (21)..(21): methylated C nucleotide
  modified_base (26)..(26): methylated C nucleotide
ggactgccggacccacgcggcggcccgccccctg

SEQ ID NO: 760 - DNA, 24 bp, Artificial Sequence
  Synthetic
  modified_base (6)..(6): methylated C nucleotide
  modified_base (14)..(14): methylated C nucleotide
  modified_base (16)..(16): methylated C nucleotide
  modified_base (19)..(19): methylated C nucleotide
  modified_base (24)..(24): methylated C nucleotide
actgccggacccacgcggcggccc

SEQ ID NO: 761 - DNA, 24 bp, Artificial Sequence
  Synthetic
  modified_base (9)..(9): methylated C nucleotide
  modified_base (17)..(17): methylated C nucleotide
  modified_base (19)..(19): methylated C nucleotide
  modified_base (22)..(22): methylated C nucleotide
gggactgccggacccacgcggcgg

SEQ ID NO: 762 - DNA, 24 bp, Artificial Sequence
  Synthetic
  modified_base (12)..(12): methylated C nucleotide
  modified_base (20)..(20): methylated C nucleotide
  modified_base (22)..(22): methylated C nucleotide
ggagggactgccggacccacgcgg

SEQ ID NO: 763 - DNA, 24 bp, Artificial Sequence
  Synthetic
  modified_base (15)..(15): methylated C nucleotide
  modified_base (23)..(23): methylated C nucleotide
ggaggagggactgccggacccacg

SEQ ID NO: 764 - DNA, 24 bp, Artificial Sequence
  Synthetic
  modified_base (18)..(18): methylated C nucleotide
gcgggaggagggactgccggaccc

SEQ ID NO: 765 - DNA, 24 bp, Artificial Sequence
  Synthetic
  modified_base (8)..(8): methylated C nucleotide
  modified_base (10)..(10): methylated C nucleotide
  modified_base (13)..(13): methylated C nucleotide
  modified_base (18)..(18): methylated C nucleotide
ggacccacgcggcggcccgccccc

SEQ ID NO: 766 - DNA, 24 bp, Artificial Sequence
  Synthetic
  modified_base (5)..(5): methylated C nucleotide
  modified_base (7)..(7): methylated C nucleotide
  modified_base (10)..(10): methylated C nucleotide
  modified_base (15)..(15): methylated C nucleotide
cccacgcggcggcccgccccctgc

SEQ ID NO: 767 - DNA, 24 bp, Artificial Sequence
  Synthetic
  modified_base (2)..(2): methylated C nucleotide
  modified_base (4)..(4): methylated C nucleotide
  modified_base (7)..(7): methylated C nucleotide
  modified_base (12)..(12): methylated C nucleotide
acgcggcggcccgccccctgccta

SEQ ID NO: 768 - DNA, 24 bp, Artificial Sequence
  Synthetic
  modified_base (1)..(1): methylated C nucleotide
  modified_base (4)..(4): methylated C nucleotide
  modified_base (9)..(9): methylated C nucleotide
cggcggcccgccccctgcctagcc

SEQ ID NO: 769 - DNA, 24 bp, Artificial Sequence
  Synthetic
  modified_base (1)..(1): methylated C nucleotide
  modified_base (6)..(6): methylated C nucleotide
cggcccgccccctgcctagccgca

SEQ ID NO: 770 - DNA, 22 bp, Artificial Sequence
  Synthetic
  modified_base (1)..(1): methylated C nucleotide
  modified_base (9)..(9): methylated C nucleotide
  modified_base (11)..(11): methylated C nucleotide
  modified_base (14)..(14): methylated C nucleotide
  modified_base (19)..(19): methylated C nucleotide
cggacccacgcggcggcccgcc

SEQ ID NO: 771 - DNA, 20 bp, Artificial Sequence
  Synthetic
  modified_base (7)..(7): methylated C nucleotide
  modified_base (9)..(9): methylated C nucleotide
  modified_base (12)..(12): methylated C nucleotide
  modified_base (17)..(17): methylated C nucleotide
gacccacgcggcggcccgcc

SEQ ID NO: 772 - DNA, 18 bp, Artificial Sequence
  Synthetic
  modified_base (5)..(5): methylated C nucleotide
  modified_base (7)..(7): methylated C nucleotide
  modified_base (10)..(10): methylated C nucleotide
  modified_base (15)..(15): methylated C nucleotide
cccacgcggcggcccgcc

SEQ ID NO: 773 - DNA, 16 bp, Artificial Sequence
  Synthetic
  modified_base (3)..(3): methylated C nucleotide
  modified_base (5)..(5): methylated C nucleotide
  modified_base (8)..(8): methylated C nucleotide
  modified_base (13)..(13): methylated C nucleotide
cacgcggcggcccgcc

SEQ ID NO: 774 - DNA, 15 bp, Artificial Sequence
  Synthetic
  modified_base (2)..(2): methylated C nucleotide
  modified_base (4)..(4): methylated C nucleotide
  modified_base (7)..(7): methylated C nucleotide
  modified_base (12)..(12): methylated C nucleotide
acgcggcggcccgcc

SEQ ID NO: 775 - DNA, 22 bp, Artificial Sequence
  Synthetic
  modified_base (3)..(3): methylated C nucleotide
  modified_base (11)..(11): methylated C nucleotide
  modified_base (13)..(13): methylated C nucleotide
  modified_base (16)..(16): methylated C nucleotide
  modified_base (21)..(21): methylated C nucleotide
gccggacccacgcggcggcccg

SEQ ID NO: 776 - DNA, 20 bp, Artificial Sequence
  Synthetic
  modified_base (3)..(3): methylated C nucleotide
  modified_base (11)..(11): methylated C nucleotide
  modified_base (13)..(13): methylated C nucleotide
  modified_base (16)..(16): methylated C nucleotide
gccggacccacgcggcggcc

SEQ ID NO: 777 - DNA, 18 bp, Artificial Sequence
  Synthetic
  modified_base (3)..(3): methylated C nucleotide
  modified_base (11)..(11): methylated C nucleotide
  modified_base (13)..(13): methylated C nucleotide
  modified_base (16)..(16): methylated C nucleotide
gccggacccacgcggcgg

SEQ ID NO: 778 - DNA, 16 bp, Artificial Sequence
  Synthetic
  modified_base (3)..(3): methylated C nucleotide
  modified_base (11)..(11): methylated C nucleotide
  modified_base (13)..(13): methylated C nucleotide
  modified_base (16)..(16): methylated C nucleotide
gccggacccacgcggc

SEQ ID NO: 779 - DNA, 15 bp, Artificial Sequence
  Synthetic
  modified_base (3)..(3): methylated C nucleotide
  modified_base (11)..(11): methylated C nucleotide
  modified_base (13)..(13): methylated C nucleotide
gccggacccacgcgg

SEQ ID NO: 780 - DNA, 24 bp, Artificial Sequence
  Synthetic
  modified_base (3)..(3): methylated C nucleotide
  modified_base (11)..(11): methylated C nucleotide
  modified_base (13)..(13): methylated C nucleotide
  modified_base (16)..(16): methylated C nucleotide
  modified_base (21)..(21): methylated C nucleotide
gccgggcccacgcggcggcccgcc

SEQ ID NO: 781 - DNA, 24 bp, Artificial Sequence
  Synthetic
  modified_base (3)..(3): methylated C nucleotide
  modified_base (11)..(11): methylated C nucleotide
  modified_base (13)..(13): methylated C nucleotide
  modified_base (16)..(16): methylated C nucleotide
  modified_base (21)..(21): methylated C nucleotide
gccggacccacgctgcggcccgcc

SEQ ID NO: 782 - DNA, 24 bp, Artificial Sequence
  Synthetic
  modified_base (3)..(3): methylated C nucleotide
  modified_base (11)..(11): methylated C nucleotide
  modified_base (13)..(13): methylated C nucleotide
  modified_base (16)..(16): methylated C nucleotide
  modified_base (21)..(21): methylated C nucleotide
gccggacccacgcggcggtccgcc

SEQ ID NO: 783 - DNA, 27 bp, Artificial Sequence
  Synthetic
  modified_base (3)..(3)
  modified_base (6)..(6)
  modified_base (9)..(9)
  modified_base (18)..(18)
  modified_base (21)..(21)
  modified_base (24)..(24)
ttcgccgccgccactgccgccgccgct

SEQ ID NO: 784 - DNA, 28 bp, Artificial Sequence
  Synthetic
  modified_base (4)..(4): methylated C nucleotide
  modified_base (7)..(7): methylated C nucleotide
  modified_base (10)..(10): methylated C nucleotide
  modified_base (19)..(19): methylated C nucleotide
  modified_base (22)..(22): methylated C nucleotide
  modified_base (25)..(25): methylated C nucleotide
cttcgccgccgccactgccgccgccgct

SEQ ID NO: 785 - DNA, 29 bp, Artificial Sequence
  Synthetic
  modified_base (5)..(5): methylated C nucleotide
  modified_base (8)..(8): methylated C nucleotide
  modified_base (11)..(11): methylated C nucleotide
  modified_base (20)..(20): methylated C nucleotide
  modified_base (23)..(23): methylated C nucleotide
  modified_base (26)..(26): methylated C nucleotide
ccttcgccgccgccactgccgccgccgct

SEQ ID NO: 786 - DNA, 30 bp, Artificial Sequence
  Synthetic
  modified_base (6)..(6): methylated C nucleotide
  modified_base (9)..(9): methylated C nucleotide
  modified_base (12)..(12): methylated C nucleotide
  modified_base (21)..(21): methylated C nucleotide
  modified_base (24)..(24): methylated C nucleotide
  modified_base (27)..(27): methylated C nucleotide
accttcgccgccgccactgccgccgccgct

SEQ ID NO: 787 - DNA, 31 bp, Artificial Sequence
  Synthetic
  modified_base (7)..(7): methylated C nucleotide
  modified_base (10)..(10): methylated C nucleotide
  modified_base (13)..(13): methylated C nucleotide
  modified_base (22)..(22): methylated C nucleotide
  modified_base (25)..(25): methylated C nucleotide
  modified_base (28)..(28): methylated C nucleotide
caccttcgccgccgccactgccgccgccgct

SEQ ID NO: 788 - DNA, 32 bp, Artificial Sequence
  Synthetic
  modified_base (8)..(8): methylated C nucleotide
  modified_base (11)..(11): methylated C nucleotide
  modified_base (14)..(14): methylated C nucleotide
  modified_base (23)..(23): methylated C nucleotide
  modified_base (26)..(26): methylated C nucleotide
  modified_base (29)..(29): methylated C nucleotide
ccaccttcgccgccgccactgccgccgccgct

SEQ ID NO: 789 - DNA, 28 bp, Artificial Sequence
  Synthetic
  modified_base (3)..(3): methylated C nucleotide
  modified_base (6)..(6): methylated C nucleotide
  modified_base (9)..(9): methylated C nucleotide
  modified_base (18)..(18): methylated C nucleotide
  modified_base (21)..(21): methylated C nucleotide
  modified_base (24)..(24): methylated C nucleotide
ttcgccgccgccactgccgccgccgctg

SEQ ID NO: 790 - DNA, 29 bp, Artificial Sequence
  Synthetic
  modified_base (3)..(3): methylated C nucleotide
  modified_base (6)..(6): methylated C nucleotide
  modified_base (9)..(9): methylated C nucleotide
  modified_base (18)..(18): methylated C nucleotide
  modified_base (21)..(21): methylated C nucleotide
  modified_base (24)..(24): methylated C nucleotide
ttcgccgccgccactgccgccgccgctgc

SEQ ID NO: 791 - DNA, 30 bp, Artificial Sequence
  Synthetic
  modified_base (3)..(3): methylated C nucleotide
  modified_base (6)..(6): methylated C nucleotide
  modified_base (9)..(9): methylated C nucleotide
  modified_base (18)..(18): methylated C nucleotide
  modified_base (21)..(21): methylated C nucleotide
  modified_base (24)..(24): methylated C nucleotide
ttcgccgccgccactgccgccgccgctgct

SEQ ID NO: 792 - DNA, 31 bp, Artificial Sequence
  Synthetic
  modified_base (3)..(3): methylated C nucleotide
  modified_base (6)..(6): methylated C nucleotide
  modified_base (9)..(9): methylated C nucleotide
  modified_base (18)..(18): methylated C nucleotide
  modified_base (21)..(21): methylated C nucleotide
  modified_base (24)..(24): methylated C nucleotide
ttcgccgccgccactgccgccgccgctgctg

SEQ ID NO: 793 - DNA, 32 bp, Artificial Sequence
  Synthetic
  modified_base (3)..(3): methylated C nucleotide
  modified_base (6)..(6): methylated C nucleotide
  modified_base (9)..(9): methylated C nucleotide
  modified_base (18)..(18): methylated C nucleotide
  modified_base (21)..(21): methylated C nucleotide
  modified_base (24)..(24): methylated C nucleotide
ttcgccgccgccactgccgccgccgctgctgc

SEQ ID NO: 794 - DNA, 29 bp, Artificial Sequence
  Synthetic
  modified_base (4)..(4): methylated C nucleotide
  modified_base (7)..(7): methylated C nucleotide
  modified_base (10)..(10): methylated C nucleotide
  modified_base (19)..(19): methylated C nucleotide
  modified_base (22)..(22): methylated C nucleotide
  modified_base (25)..(25): methylated C nucleotide
cttcgccgccgccactgccgccgccgctg

SEQ ID NO: 795 - DNA, 31 bp, Artificial Sequence
  Synthetic
  modified_base (5)..(5): methylated C nucleotide
  modified_base (8)..(8): methylated C nucleotide
  modified_base (11)..(11): methylated C nucleotide
  modified_base (20)..(20): methylated C nucleotide
  modified_base (23)..(23): methylated C nucleotide
  modified_base (26)..(26): methylated C nucleotide
ccttcgccgccgccactgccgccgccgctgc

SEQ ID NO: 796 - DNA, 33 bp, Artificial Sequence
  Synthetic
  modified_base (6)..(6): methylated C nucleotide
  modified_base (9)..(9): methylated C nucleotide
  modified_base (12)..(12): methylated C nucleotide
  modified_base (21)..(21): methylated C nucleotide
  modified_base (24)..(24): methylated C nucleotide
  modified_base (27)..(27): methylated C nucleotide
accttcgccgccgccactgccgccgccgctgct

SEQ ID NO: 797 - DNA, 35 bp, Artificial Sequence
  Synthetic
  modified_base (7)..(7): methylated C nucleotide
  modified_base (10)..(10): methylated C nucleotide
  modified_base (13)..(13): methylated C nucleotide
  modified_base (22)..(22): methylated C nucleotide
  modified_base (25)..(25): methylated C nucleotide
  modified_base (28)..(28): methylated C nucleotide
caccttcgccgccgccactgccgccgccgctgctg

SEQ ID NO: 798 - DNA, 37 bp, Artificial Sequence
  Synthetic
  modified_base (8)..(8): methylated C nucleotide
  modified_base (11)..(11): methylated C nucleotide
  modified_base (14)..(14): methylated C nucleotide
  modified_base (23)..(23): methylated C nucleotide
  modified_base (26)..(26): methylated C nucleotide
  modified_base (29)..(29): methylated C nucleotide
ccaccttcgccgccgccactgccgccgccgctgctgc

SEQ ID NO: 799 - DNA, 27 bp, Artificial Sequence
  Synthetic
  modified_base (6)..(6): methylated C nucleotide
  modified_base (9)..(9): methylated C nucleotide
  modified_base (12)..(12): methylated C nucleotide
  modified_base (21)..(21): methylated C nucleotide
  modified_base (24)..(24): methylated C nucleotide
  modified_base (27)..(27): methylated C nucleotide
accttcgccgccgccactgccgccgcc

SEQ ID NO: 800 - DNA, 27 bp, Artificial Sequence
  Synthetic
  modified_base (9)..(9): methylated C nucleotide
  modified_base (12)..(12): methylated C nucleotide
  modified_base (15)..(15): methylated C nucleotide
  modified_base (24)..(24): methylated C nucleotide
  modified_base (27)..(27): methylated C nucleotide
gccaccttcgccgccgccactgccgcc

SEQ ID NO: 801 - DNA, 27 bp, Artificial Sequence
  Synthetic
  modified_base (12)..(12): methylated C nucleotide
  modified_base (15)..(15): methylated C nucleotide
  modified_base (18)..(18): methylated C nucleotide
  modified_base (27)..(27): methylated C nucleotide
gccgccaccttcgccgccgccactgcc

SEQ ID NO: 802 - DNA, 27 bp, Artificial Sequence
  Synthetic
  modified_base (15)..(15): methylated C nucleotide
  modified_base (18)..(18): methylated C nucleotide
  modified_base (21)..(21): methylated C nucleotide
gccgccgccaccttcgccgccgccact

SEQ ID NO: 803 - DNA, 27 bp, Artificial Sequence
  Synthetic
  modified_base (18)..(18): methylated C nucleotide
  modified_base (21)..(21): methylated C nucleotide
  modified_base (24)..(24): methylated C nucleotide
cgagccgccgccaccttcgccgccgcc

SEQ ID NO: 804 - DNA, 27 bp, Artificial Sequence
  Synthetic
  modified_base (3)..(3): methylated C nucleotide
  modified_base (6)..(6): methylated C nucleotide
  modified_base (15)..(15): methylated C nucleotide
  modified_base (18)..(18): methylated C nucleotide
  modified_base (21)..(21): methylated C nucleotide
gccgccgccactgccgccgccgctgct

SEQ ID NO: 805 - DNA, 27 bp, Artificial Sequence
  Synthetic
  modified_base (3)..(3): methylated C nucleotide
  modified_base (12)..(12): methylated C nucleotide
  modified_base (15)..(15): methylated C nucleotide
  modified_base (18)..(18): methylated C nucleotide
gccgccactgccgccgccgctgctgcc

SEQ ID NO: 806 - DNA, 27 bp, Artificial Sequence
  Synthetic
  modified_base (9)..(9): methylated C nucleotide
  modified_base (12)..(12): methylated C nucleotide
  modified_base (15)..(15): methylated C nucleotide
gccactgccgccgccgctgctgcctcc

SEQ ID NO: 807 - DNA, 27 bp, Artificial Sequence
  Synthetic
  modified_base (6)..(6): methylated C nucleotide
  modified_base (9)..(9): methylated C nucleotide
  modified_base (12)..(12): methylated C nucleotide
actgccgccgccgctgctgcctccgcc

SEQ ID NO: 808 - DNA, 27 bp, Artificial Sequence
  Synthetic
  modified_base (3)..(3): methylated C nucleotide
  modified_base (6)..(6): methylated C nucleotide
  modified_base (9)..(9): methylated C nucleotide
gccgccgccgctgctgcctccgccgcc

SEQ ID NO: 809 - DNA, 25 bp, Artificial Sequence
  Synthetic
  modified_base (1)..(1): methylated C nucleotide
  modified_base (4)..(4): methylated C nucleotide
  modified_base (7)..(7): methylated C nucleotide
  modified_base (16)..(16): methylated C nucleotide
  modified_base (19)..(19): methylated C nucleotide
cgccgccgccactgccgccgccgct

SEQ ID NO: 810 - DNA, 23 bp, Artificial Sequence
  Synthetic
  modified_base (2)..(2): methylated C nucleotide
  modified_base (5)..(5): methylated C nucleotide
  modified_base (14)..(14): methylated C nucleotide
  modified_base (17)..(17): methylated C nucleotide
  modified_base (20)..(20): methylated C nucleotide
ccgccgccactgccgccgccgct

SEQ ID NO: 811 - DNA, 21 bp, Artificial Sequence
  Synthetic
  modified_base (3)..(3)
  modified_base (12)..(12)
  modified_base (15)..(15)
  modified_base (18)..(18)
gccgccactgccgccgccgct

SEQ ID NO: 812 - DNA, 19 bp, Artificial Sequence
  Synthetic
  modified_base (1)..(1): methylated C nucleotide
  modified_base (10)..(10): methylated C nucleotide
  modified_base (13)..(13): methylated C nucleotide
  modified_base (16)..(16): methylated C nucleotide
cgccactgccgccgccgct

SEQ ID NO: 813 - DNA, 17 bp, Artificial Sequence
  Synthetic
  modified_base (8)..(8): methylated C nucleotide
  modified_base (11)..(11): methylated C nucleotide
  modified_base (14)..(14): methylated C nucleotide
ccactgccgccgccgct

SEQ ID NO: 814 - DNA, 15 bp, Artificial Sequence
  Synthetic
  modified_base (6)..(6): methylated C nucleotide
  modified_base (9)..(9): methylated C nucleotide
  modified_base (12)..(12): methylated C nucleotide
actgccgccgccgct

SEQ ID NO: 815 - DNA, 25 bp, Artificial Sequence
  Synthetic
  modified_base (3)..(3): methylated C nucleotide
  modified_base (6)..(6): methylated C nucleotide
  modified_base (9)..(9): methylated C nucleotide
  modified_base (18)..(18): methylated C nucleotide
  modified_base (21)..(21): methylated C nucleotide
  modified_base (24)..(24): methylated C nucleotide
ttcgccgccgccactgccgccgccg

SEQ ID NO: 816 - DNA, 23 bp, Artificial Sequence
  Synthetic
  modified_base (3)..(3): methylated C nucleotide
  modified_base (6)..(6): methylated C nucleotide
  modified_base (9)..(9): methylated C nucleotide
  modified_base (18)..(18): methylated C nucleotide
  modified_base (21)..(21): methylated C nucleotide
ttcgccgccgccactgccgccgc

SEQ ID NO: 817 - DNA, 21 bp, Artificial Sequence
  Synthetic
  modified_base (3)..(3): methylated C nucleotide
  modified_base (6)..(6): methylated C nucleotide
  modified_base (9)..(9): methylated C nucleotide
  modified_base (18)..(18): methylated C nucleotide
  modified_base (21)..(21): methylated C nucleotide
ttcgccgccgccactgccgcc

SEQ ID NO: 818 - DNA, 19 bp, Artificial Sequence
  Synthetic
  modified_base (3)..(3): methylated C nucleotide
  modified_base (6)..(6): methylated C nucleotide
  modified_base (9)..(9): methylated C nucleotide
  modified_base (18)..(18): methylated C nucleotide
ttcgccgccgccactgccg

SEQ ID NO: 819 - DNA, 17 bp, Artificial Sequence
  Synthetic
  modified_base (3)..(3): methylated C nucleotide
  modified_base (6)..(6): methylated C nucleotide
  modified_base (9)..(9): methylated C nucleotide
ttcgccgccgccactgc

SEQ ID NO: 820 - DNA, 15 bp, Artificial Sequence
  Synthetic
  modified_base (3)..(3): methylated C nucleotide
  modified_base (6)..(6): methylated C nucleotide
  modified_base (9)..(9): methylated C nucleotide
ttcgccgccgccact

SEQ ID NO: 821 - DNA, 27 bp, Artificial Sequence
  Synthetic
  modified_base (3)..(3): methylated C nucleotide
  modified_base (6)..(6): methylated C nucleotide
  modified_base (9)..(9): methylated C nucleotide
  modified_base (18)..(18): methylated C nucleotide
  modified_base (21)..(21): methylated C nucleotide
  modified_base (24)..(24): methylated C nucleotide
ttcaccgccgccactgccgccgccgct

SEQ ID NO: 822 - DNA, 27 bp, Artificial Sequence
  Synthetic
  modified_base (3)..(3): methylated C nucleotide
  modified_base (6)..(6): methylated C nucleotide
  modified_base (9)..(9): methylated C nucleotide
  modified_base (18)..(18): methylated C nucleotide
  modified_base (21)..(21): methylated C nucleotide
  modified_base (24)..(24): methylated C nucleotide
ttcgccgccgccactcccgccgccgct

SEQ ID NO: 823 - DNA, 27 bp, Artificial Sequence
  Synthetic
  modified_base (3)..(3): methylated C nucleotide
  modified_base (6)..(6): methylated C nucleotide
  modified_base (9)..(9): methylated C nucleotide
  modified_base (18)..(18): methylated C nucleotide
  modified_base (21)..(21): methylated C nucleotide
  modified_base (24)..(24): methylated C nucleotide
ttcgccgccgtcactgccgccgccgct

SEQ ID NO: 824 - DNA, 28 bp, Artificial Sequence
  Synthetic
gcggccacgccgccccgctgaccggtct

SEQ ID NO: 825 - DNA, 29 bp, Artificial Sequence
  Synthetic
agcggccacgccgccccgctgaccggtct

SEQ ID NO: 826 - DNA, 30 bp, Artificial Sequence
  Synthetic
gagcggccacgccgccccgctgaccggtct

SEQ ID NO: 827 - DNA, 31 bp, Artificial Sequence
  Synthetic
cgagcggccacgccgccccgctgaccggtct

SEQ ID NO: 828 - DNA, 32 bp, Artificial Sequence
  Synthetic
gcgagcggccacgccgccccgctgaccggtct

SEQ ID NO: 829 - DNA, 33 bp, Artificial Sequence
  Synthetic
cgcgagcggccacgccgccccgctgaccggtct

SEQ ID NO: 830 - DNA, 29 bp, Artificial Sequence
  Synthetic
gcggccacgccgccccgctgaccggtctc

SEQ ID NO: 831 - DNA, 30 bp, Artificial Sequence
  Synthetic
gcggccacgccgccccgctgaccggtctcc

SEQ ID NO: 832 - DNA, 31 bp, Artificial Sequence
  Synthetic
gcggccacgccgccccgctgaccggtctcca

SEQ ID NO: 833 - DNA, 32 bp, Artificial Sequence
  Synthetic
gcggccacgccgccccgctgaccggtctccac

SEQ ID NO: 834 - DNA, 33 bp, Artificial Sequence
  Synthetic
gcggccacgccgccccgctgaccggtctccaca

SEQ ID NO: 835 - DNA, 30 bp, Artificial Sequence
  Synthetic
agcggccacgccgccccgctgaccggtctc

SEQ ID NO: 836 - DNA, 32 bp, Artificial Sequence
  Synthetic
gagcggccacgccgccccgctgaccggtctcc

SEQ ID NO: 837 - DNA, 34 bp, Artificial Sequence
  Synthetic
cgagcggccacgccgccccgctgaccggtctcca

SEQ ID NO: 838 - DNA, 36 bp, Artificial Sequence
  Synthetic
gcgagcggccacgccgccccgctgaccggtctccac

SEQ ID NO: 839 - DNA, 38 bp, Artificial Sequence
  Synthetic
cgcgagcggccacgccgccccgctgaccggtctccaca

SEQ ID NO: 840 - DNA, 28 bp, Artificial Sequence
  Synthetic
cgagcggccacgccgccccgctgaccgg

SEQ ID NO: 841 - DNA, 28 bp, Artificial Sequence
  Synthetic
ccgcgagcggccacgccgccccgctgac

SEQ ID NO: 842 - DNA, 28 bp, Artificial Sequence
  Synthetic
acgccgcgagcggccacgccgccccgct

SEQ ID NO: 843 - DNA, 28 bp, Artificial Sequence
  Synthetic
gagacgccgcgagcggccacgccgcccc

SEQ ID NO: 844 - DNA, 28 bp, Artificial Sequence
  Synthetic
agggagacgccgcgagcggccacgccgc

SEQ ID NO: 845 - DNA, 28 bp, Artificial Sequence
  Synthetic
gccacgccgccccgctgaccggtctcca

SEQ ID NO: 846 - DNA, 28 bp, Artificial Sequence
  Synthetic
acgccgccccgctgaccggtctccacag

SEQ ID NO: 847 - DNA, 28 bp, Artificial Sequence
  Synthetic
ccgccccgctgaccggtctccacagaga

SEQ ID NO: 848 - DNA, 28 bp, Artificial Sequence
  Synthetic
ccccgctgaccggtctccacagagaagc

SEQ ID NO: 849 - DNA, 28 bp, Artificial Sequence
  Synthetic
cgctgaccggtctccacagagaagctgc

SEQ ID NO: 850 - DNA, 26 bp, Artificial Sequence
  Synthetic
ggccacgccgccccgctgaccggtct

SEQ ID NO: 851 - DNA, 24 bp, Artificial Sequence
  Synthetic
ccacgccgccccgctgaccggtct

SEQ ID NO: 852 - DNA, 22 bp, Artificial Sequence
  Synthetic
acgccgccccgctgaccggtct

SEQ ID NO: 853 - DNA, 20 bp, Artificial Sequence
  Synthetic
gccgccccgctgaccggtct

SEQ ID NO: 854 - DNA, 18 bp, Artificial Sequence
  Synthetic
cgccccgctgaccggtct

SEQ ID NO: 855 - DNA, 16 bp, Artificial Sequence
  Synthetic
ccccgctgaccggtct

SEQ ID NO: 856 - DNA, 15 bp, Artificial Sequence
  Synthetic
cccgctgaccggtct

SEQ ID NO: 857 - DNA, 26 bp, Artificial Sequence
  Synthetic
gcggccacgccgccccgctgaccggt

SEQ ID NO: 858 - DNA, 24 bp, Artificial Sequence
  Synthetic
gcggccacgccgccccgctgaccg

SEQ ID NO: 859 - DNA, 22 bp, Artificial Sequence
  Synthetic
gcggccacgccgccccgctgac

SEQ ID NO: 860 - DNA, 20 bp, Artificial Sequence
  Synthetic
gcggccacgccgccccgctg

SEQ ID NO: 861 - DNA, 18 bp, Artificial Sequence
  Synthetic
gcggccacgccgccccgc

SEQ ID NO: 862 - DNA, 16 bp, Artificial Sequence
  Synthetic
gcggccacgccgcccc

SEQ ID NO: 863 - DNA, 15 bp, Artificial Sequence
  Synthetic
gcggccacgccgccc

SEQ ID NO: 864 - DNA, 28 bp, Artificial Sequence
  Synthetic
gcggccacgacgccccgctgaccggtct

SEQ ID NO: 865 - DNA, 28 bp, Artificial Sequence
  Synthetic
gcggccacgccgctccgctgaccggtct

SEQ ID NO: 866 - DNA, 28 bp, Artificial Sequence
  Synthetic
gcggccacgccgccccgcggaccggtct

SEQ ID NO: 867 - DNA, 26 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (12)..(12): methylated C nucleotide
  modified_base (17)..(17): methylated C nucleotide
  modified_base (19)..(19): methylated C nucleotide
ggcgcgcggttcgccccgcgcatggg

SEQ ID NO: 868 - DNA, 27 bp, Artificial Sequence
  Synthetic
  modified_base (4)..(4): methylated C nucleotide
  modified_base (6)..(6): methylated C nucleotide
  modified_base (8)..(8): methylated C nucleotide
  modified_base (13)..(13): methylated C nucleotide
  modified_base (18)..(18): methylated C nucleotide
  modified_base (20)..(20): methylated C nucleotide
gggcgcgcggttcgccccgcgcatggg

SEQ ID NO: 869 - DNA, 28 bp, Artificial Sequence
  Synthetic
  modified_base (5)..(5): methylated C nucleotide
  modified_base (7)..(7): methylated C nucleotide
  modified_base (9)..(9): methylated C nucleotide
  modified_base (14)..(14): methylated C nucleotide
  modified_base (19)..(19): methylated C nucleotide
  modified_base (21)..(21): methylated C nucleotide
ggggcgcgcggttcgccccgcgcatggg

SEQ ID NO: 870 - DNA, 29 bp, Artificial Sequence
  Synthetic
  modified_base (6)..(6): methylated C nucleotide
  modified_base (8)..(8): methylated C nucleotide
  modified_base (10)..(10): methylated C nucleotide
  modified_base (15)..(15): methylated C nucleotide
  modified_base (20)..(20): methylated C nucleotide
  modified_base (22)..(22): methylated C nucleotide
gggggcgcgcggttcgccccgcgcatggg

SEQ ID NO: 871 - DNA, 30 bp, Artificial Sequence
  Synthetic
  modified_base (7)..(7): methylated C nucleotide
  modified_base (9)..(9): methylated C nucleotide
  modified_base (11)..(11): methylated C nucleotide
  modified_base (16)..(16): methylated C nucleotide
  modified_base (21)..(21): methylated C nucleotide
  modified_base (23)..(23): methylated C nucleotide
cgggggcgcgcggttcgccccgcgcatggg

SEQ ID NO: 872 - DNA, 31 bp, Artificial Sequence
  Synthetic
  modified_base (8)..(8): methylated C nucleotide
  modified_base (10)..(10): methylated C nucleotide
  modified_base (12)..(12): methylated C nucleotide
  modified_base (17)..(17): methylated C nucleotide
  modified_base (22)..(22): methylated C nucleotide
  modified_base (24)..(24): methylated C nucleotide
gcgggggcgcgcggttcgccccgcgcatggg

SEQ ID NO: 873 - DNA, 27 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (12)..(12): methylated C nucleotide
  modified_base (17)..(17): methylated C nucleotide
  modified_base (19)..(19): methylated C nucleotide
ggcgcgcggttcgccccgcgcatgggc

SEQ ID NO: 874 - DNA, 28 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (12)..(12): methylated C nucleotide
  modified_base (17)..(17): methylated C nucleotide
  modified_base (19)..(19): methylated C nucleotide
ggcgcgcggttcgccccgcgcatgggct

SEQ ID NO: 875 - DNA, 29 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (12)..(12): methylated C nucleotide
  modified_base (17)..(17): methylated C nucleotide
  modified_base (19)..(19): methylated C nucleotide
ggcgcgcggttcgccccgcgcatgggctc

SEQ ID NO: 876 - DNA, 30 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (12)..(12): methylated C nucleotide
  modified_base (17)..(17): methylated C nucleotide
  modified_base (19)..(19): methylated C nucleotide
ggcgcgcggttcgccccgcgcatgggctcc

SEQ ID NO: 877 - DNA, 31 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (12)..(12): methylated C nucleotide
  modified_base (17)..(17): methylated C nucleotide
  modified_base (19)..(19): methylated C nucleotide
ggcgcgcggttcgccccgcgcatgggctccg

SEQ ID NO: 878 - DNA, 28 bp, Artificial Sequence
  Synthetic
  modified_base (4)..(4): methylated C nucleotide
  modified_base (6)..(6): methylated C nucleotide
  modified_base (8)..(8): methylated C nucleotide
  modified_base (13)..(13): methylated C nucleotide
  modified_base (18)..(18): methylated C nucleotide
  modified_base (20)..(20): methylated C nucleotide
gggcgcgcggttcgccccgcgcatgggc

SEQ ID NO: 879 - DNA, 30 bp, Artificial Sequence
  Synthetic
  modified_base (5)..(5): methylated C nucleotide
  modified_base (7)..(7): methylated C nucleotide
  modified_base (9)..(9): methylated C nucleotide
  modified_base (14)..(14): methylated C nucleotide
  modified_base (19)..(19): methylated C nucleotide
  modified_base (21)..(21): methylated C nucleotide
ggggcgcgcggttcgccccgcgcatgggct

SEQ ID NO: 880 - DNA, 32 bp, Artificial Sequence
  Synthetic
  modified_base (6)..(6): methylated C nucleotide
  modified_base (8)..(8): methylated C nucleotide
  modified_base (10)..(10): methylated C nucleotide
  modified_base (15)..(15): methylated C nucleotide
  modified_base (20)..(20): methylated C nucleotide
  modified_base (22)..(22): methylated C nucleotide
gggggcgcgcggttcgccccgcgcatgggctc

SEQ ID NO: 881 - DNA, 34 bp, Artificial Sequence
  Synthetic
  modified_base (7)..(7): methylated C nucleotide
  modified_base (9)..(9): methylated C nucleotide
  modified_base (11)..(11): methylated C nucleotide
  modified_base (16)..(16): methylated C nucleotide
  modified_base (21)..(21): methylated C nucleotide
  modified_base (23)..(23): methylated C nucleotide
cgggggcgcgcggttcgccccgcgcatgggctcc

SEQ ID NO: 882 - DNA, 36 bp, Artificial Sequence
  Synthetic
  modified_base (8)..(8): methylated C nucleotide
  modified_base (10)..(10): methylated C nucleotide
  modified_base (12)..(12): methylated C nucleotide
  modified_base (17)..(17): methylated C nucleotide
  modified_base (22)..(22): methylated C nucleotide
  modified_base (24)..(24): methylated C nucleotide
gcgggggcgcgcggttcgccccgcgcatgggctccg

SEQ ID NO: 883 - DNA, 26 bp, Artificial Sequence
  Synthetic
  modified_base (6)..(6): methylated C nucleotide
  modified_base (8)..(8): methylated C nucleotide
  modified_base (10)..(10): methylated C nucleotide
  modified_base (15)..(15): methylated C nucleotide
  modified_base (20)..(20): methylated C nucleotide
  modified_base (22)..(22): methylated C nucleotide
gggggcgcgcggttcgccccgcgcat

SEQ ID NO: 884 - DNA, 26 bp, Artificial Sequence
  Synthetic
  modified_base (9)..(9): methylated C nucleotide
  modified_base (11)..(11): methylated C nucleotide
  modified_base (13)..(13): methylated C nucleotide
  modified_base (18)..(18): methylated C nucleotide
  modified_base (23)..(23): methylated C nucleotide
  modified_base (25)..(25): methylated C nucleotide
ggcgggggcgcgcggttcgccccgcg

SEQ ID NO: 885 - DNA, 26 bp, Artificial Sequence
  Synthetic
  modified_base (12)..(12): methylated C nucleotide
  modified_base (14)..(14): methylated C nucleotide
  modified_base (16)..(16): methylated C nucleotide
  modified_base (21)..(21): methylated C nucleotide
  modified_base (26)..(26): methylated C nucleotide
gggggcgggggcgcgcggttcgcccc

SEQ ID NO: 886 - DNA, 26 bp, Artificial Sequence
  Synthetic
  modified_base (15)..(15): methylated C nucleotide
  modified_base (17)..(17): methylated C nucleotide
  modified_base (19)..(19): methylated C nucleotide
  modified_base (24)..(24): methylated C nucleotide
ggcgggggcgggggcgcgcggttcgc

SEQ ID NO: 887 - DNA, 26 bp, Artificial Sequence
  Synthetic
  modified_base (18)..(18): methylated C nucleotide
  modified_base (20)..(20): methylated C nucleotide
  modified_base (22)..(22): methylated C nucleotide
cggggcgggggcgggggcgcgcggtt

SEQ ID NO: 888 - DNA, 26 bp, Artificial Sequence
  Synthetic
  modified_base (2)..(2): methylated C nucleotide
  modified_base (4)..(4): methylated C nucleotide
  modified_base (9)..(9): methylated C nucleotide
  modified_base (14)..(14): methylated C nucleotide
  modified_base (16)..(16): methylated C nucleotide
gcgcggttcgccccgcgcatgggctc

SEQ ID NO: 889 - DNA, 26 bp, Artificial Sequence
  Synthetic
  modified_base (1)..(1): methylated C nucleotide
  modified_base (6)..(6): methylated C nucleotide
  modified_base (11)..(11): methylated C nucleotide
  modified_base (13)..(13): methylated C nucleotide
cggttcgccccgcgcatgggctccgt

SEQ ID NO: 890 - DNA, 26 bp, Artificial Sequence
  Synthetic
  modified_base (3)..(3): methylated C nucleotide
  modified_base (8)..(8): methylated C nucleotide
  modified_base (10)..(10): methylated C nucleotide
ttcgccccgcgcatgggctccgtccg

SEQ ID NO: 891 - DNA, 26 bp, Artificial Sequence
  Synthetic
  modified_base (5)..(5): methylated C nucleotide
  modified_base (7)..(7): methylated C nucleotide
gccccgcgcatgggctccgtccgcgg

SEQ ID NO: 892 - DNA, 26 bp, Artificial Sequence
  Synthetic
  modified_base (2)..(2): methylated C nucleotide
  modified_base (4)..(4): methylated C nucleotide
ccgcgcatgggctccgtccgcgggcc

SEQ ID NO: 893 - DNA, 24 bp, Artificial Sequence
  Synthetic
  modified_base (1)..(1): methylated C nucleotide
  modified_base (3)..(3): methylated C nucleotide
  modified_base (5)..(5): methylated C nucleotide
  modified_base (10)..(10): methylated C nucleotide
  modified_base (15)..(15): methylated C nucleotide
  modified_base (17)..(17): methylated C nucleotide
cgcgcggttcgccccgcgcatggg

SEQ ID NO: 894 - DNA, 22 bp, Artificial Sequence
  Synthetic
  modified_base (1)..(1): methylated C nucleotide
  modified_base (3)..(3): methylated C nucleotide
  modified_base (8)..(8): methylated C nucleotide
  modified_base (13)..(13): methylated C nucleotide
  modified_base (15)..(15): methylated C nucleotide
cgcggttcgccccgcgcatggg

SEQ ID NO: 895 - DNA, 20 bp, Artificial Sequence
  Synthetic
  modified_base (1)..(1): methylated C nucleotide
  modified_base (6)..(6): methylated C nucleotide
  modified_base (11)..(11): methylated C nucleotide
  modified_base (13)..(13): methylated C nucleotide
cggttcgccccgcgcatggg

SEQ ID NO: 896 - DNA, 18 bp, Artificial Sequence
  Synthetic
  modified_base (4)..(4): methylated C nucleotide
  modified_base (9)..(9): methylated C nucleotide
  modified_base (11)..(11): methylated C nucleotide
gttcgccccgcgcatggg

SEQ ID NO: 897 - DNA, 16 bp, Artificial Sequence
  Synthetic
  modified_base (2)..(2): methylated C nucleotide
  modified_base (7)..(7): methylated C nucleotide
  modified_base (9)..(9): methylated C nucleotide
tcgccccgcgcatggg

SEQ ID NO: 898 - DNA, 15 bp, Artificial Sequence
  Synthetic
  modified_base (1)..(1): methylated C nucleotide
  modified_base (6)..(6): methylated C nucleotide
  modified_base (8)..(8): methylated C nucleotide
cgccccgcgcatggg

SEQ ID NO: 899 - DNA, 24 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (12)..(12): methylated C nucleotide
  modified_base (17)..(17): methylated C nucleotide
  modified_base (19)..(19): methylated C nucleotide
ggcgcgcggttcgccccgcgcatg

SEQ ID NO: 900 - DNA, 22 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (12)..(12): methylated C nucleotide
  modified_base (17)..(17): methylated C nucleotide
  modified_base (19)..(19): methylated C nucleotide
ggcgcgcggttcgccccgcgca

SEQ ID NO: 901 - DNA, 20 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (12)..(12): methylated C nucleotide
  modified_base (17)..(17): methylated C nucleotide
  modified_base (19)..(19): methylated C nucleotide
ggcgcgcggttcgccccgcg

SEQ ID NO: 902 - DNA, 18 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (12)..(12): methylated C nucleotide
  modified_base (17)..(17): methylated C nucleotide
ggcgcgcggttcgccccg

SEQ ID NO: 903 - DNA, 16 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (12)..(12): methylated C nucleotide
ggcgcgcggttcgccc

SEQ ID NO: 904 - DNA, 15 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (12)..(12): methylated C nucleotide
ggcgcgcggttcgcc

SEQ ID NO: 905 - DNA, 26 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (12)..(12): methylated C nucleotide
  modified_base (17)..(17): methylated C nucleotide
  modified_base (19)..(19): methylated C nucleotide
ggcgcccggttcgccccgcgcatggg

SEQ ID NO: 906 - DNA, 26 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (12)..(12): methylated C nucleotide
  modified_base (17)..(17): methylated C nucleotide
  modified_base (19)..(19): methylated C nucleotide
ggcgcgcggttcgctccgcgcatggg

SEQ ID NO: 907 - DNA, 26 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (12)..(12): methylated C nucleotide
  modified_base (17)..(17): methylated C nucleotide
  modified_base (19)..(19): methylated C nucleotide
ggcgcgcagttcgccccgcgcatggg

SEQ ID NO: 908 - DNA, 27 bp, Artificial Sequence
  Synthetic
  modified_base (3)..(3): methylated C nucleotide
  modified_base (8)..(8): methylated C nucleotide
  modified_base (14)..(14): methylated C nucleotide
  modified_base (20)..(20): methylated C nucleotide
  modified_base (22)..(22): methylated C nucleotide
  modified_base (24)..(24): methylated C nucleotide
ggcggggcgggggcgggggcgcgcggt

SEQ ID NO: 909 - DNA, 28 bp, Artificial Sequence
  Synthetic
  modified_base (4)..(4): methylated C nucleotide
  modified_base (9)..(9): methylated C nucleotide
  modified_base (15)..(15): methylated C nucleotide
  modified_base (21)..(21): methylated C nucleotide
  modified_base (23)..(23): methylated C nucleotide
  modified_base (25)..(25): methylated C nucleotide
aggcggggcgggggcgggggcgcgcggt

SEQ ID NO: 910 - DNA, 29 bp, Artificial Sequence
  Synthetic
  modified_base (5)..(5): methylated C nucleotide
  modified_base (10)..(10): methylated C nucleotide
  modified_base (16)..(16): methylated C nucleotide
  modified_base (22)..(22): methylated C nucleotide
  modified_base (24)..(24): methylated C nucleotide
  modified_base (26)..(26): methylated C nucleotide
gaggcggggcgggggcgggggcgcgcggt

SEQ ID NO: 911 - DNA, 30 bp, Artificial Sequence
  Synthetic
  modified_base (6)..(6): methylated C nucleotide
  modified_base (11)..(11): methylated C nucleotide
  modified_base (17)..(17): methylated C nucleotide
  modified_base (23)..(23): methylated C nucleotide
  modified_base (25)..(25): methylated C nucleotide
  modified_base (27)..(27): methylated C nucleotide
cgaggcggggcgggggcgggggcgcgcggt

SEQ ID NO: 912 - DNA, 31 bp, Artificial Sequence
  Synthetic
  modified_base (7)..(7): methylated C nucleotide
  modified_base (12)..(12): methylated C nucleotide
  modified_base (18)..(18): methylated C nucleotide
  modified_base (24)..(24): methylated C nucleotide
  modified_base (26)..(26): methylated C nucleotide
  modified_base (28)..(28): methylated C nucleotide
ccgaggcggggcgggggcgggggcgcgcggt

SEQ ID NO: 913 - DNA, 32 bp, Artificial Sequence
  Synthetic
  modified_base (8)..(8): methylated C nucleotide
  modified_base (13)..(13): methylated C nucleotide
  modified_base (19)..(19): methylated C nucleotide
  modified_base (25)..(25): methylated C nucleotide
  modified_base (27)..(27): methylated C nucleotide
  modified_base (29)..(29): methylated C nucleotide
gccgaggcggggcgggggcgggggcgcgcggt

SEQ ID NO: 914 - DNA, 28 bp, Artificial Sequence
  Synthetic
  modified_base (3)..(3): methylated C nucleotide
  modified_base (8)..(8): methylated C nucleotide
  modified_base (14)..(14): methylated C nucleotide
  modified_base (20)..(20): methylated C nucleotide
  modified_base (22)..(22): methylated C nucleotide
  modified_base (24)..(24): methylated C nucleotide
ggcggggcgggggcgggggcgcgcggtt

SEQ ID NO: 915 - DNA, 29 bp, Artificial Sequence
  Synthetic
  modified_base (3)..(3): methylated C nucleotide
  modified_base (8)..(8): methylated C nucleotide
  modified_base (14)..(14): methylated C nucleotide
  modified_base (20)..(20): methylated C nucleotide
  modified_base (22)..(22): methylated C nucleotide
  modified_base (24)..(24): methylated C nucleotide
ggcggggcgggggcgggggcgcgcggttc

SEQ ID NO: 916 - DNA, 30 bp, Artificial Sequence
  Synthetic
  modified_base (3)..(3): methylated C nucleotide
  modified_base (8)..(8): methylated C nucleotide
  modified_base (14)..(14): methylated C nucleotide
  modified_base (20)..(20): methylated C nucleotide
  modified_base (22)..(22): methylated C nucleotide
  modified_base (24)..(24): methylated C nucleotide
ggcggggcgggggcgggggcgcgcggttcg

SEQ ID NO: 917 - DNA, 31 bp, Artificial Sequence
  Synthetic
  modified_base (3)..(3): methylated C nucleotide
  modified_base (8)..(8): methylated C nucleotide
  modified_base (14)..(14): methylated C nucleotide
  modified_base (20)..(20): methylated C nucleotide
  modified_base (22)..(22): methylated C nucleotide
  modified_base (24)..(24): methylated C nucleotide
ggcggggcgggggcgggggcgcgcggttcgc

SEQ ID NO: 918 - DNA, 32 bp, Artificial Sequence
  Synthetic
  modified_base (3)..(3): methylated C nucleotide
  modified_base (8)..(8): methylated C nucleotide
  modified_base (14)..(14): methylated C nucleotide
  modified_base (20)..(20): methylated C nucleotide
  modified_base (22)..(22): methylated C nucleotide
  modified_base (24)..(24): methylated C nucleotide
ggcggggcgggggcgggggcgcgcggttcgcc

SEQ ID NO: 919 - DNA, 29 bp, Artificial Sequence
  Synthetic
  modified_base (4)..(4): methylated C nucleotide
  modified_base (9)..(9): methylated C nucleotide
  modified_base (15)..(15): methylated C nucleotide
  modified_base (21)..(21): methylated C nucleotide
  modified_base (23)..(23): methylated C nucleotide
  modified_base (25)..(25): methylated C nucleotide
aggcggggcgggggcgggggcgcgcggtt

SEQ ID NO: 920 - DNA, 31 bp, Artificial Sequence
  Synthetic
  modified_base (5)..(5): methylated C nucleotide
  modified_base (10)..(10): methylated C nucleotide
  modified_base (16)..(16): methylated C nucleotide
  modified_base (22)..(22): methylated C nucleotide
  modified_base (24)..(24): methylated C nucleotide
  modified_base (26)..(26): methylated C nucleotide
gaggcggggcgggggcgggggcgcgcggttc

SEQ ID NO: 921 - DNA, 33 bp, Artificial Sequence
  Synthetic
  modified_base (6)..(6): methylated C nucleotide
  modified_base (11)..(11): methylated C nucleotide
  modified_base (17)..(17): methylated C nucleotide
  modified_base (23)..(23): methylated C nucleotide
  modified_base (25)..(25): methylated C nucleotide
  modified_base (27)..(27): methylated C nucleotide
cgaggcggggcgggggcgggggcgcgcggttcg

SEQ ID NO: 922 - DNA, 35 bp, Artificial Sequence
  Synthetic
  modified_base (7)..(7): methylated C nucleotide
  modified_base (12)..(12): methylated C nucleotide
  modified_base (18)..(18): methylated C nucleotide
  modified_base (24)..(24): methylated C nucleotide
  modified_base (26)..(26): methylated C nucleotide
  modified_base (28)..(28): methylated C nucleotide
ccgaggcggggcgggggcgggggcgcgcggttcgc

SEQ ID NO: 923 - DNA, 37 bp, Artificial Sequence
  Synthetic
  modified_base (8)..(8): methylated C nucleotide
  modified_base (13)..(13): methylated C nucleotide
  modified_base (19)..(19): methylated C nucleotide
  modified_base (25)..(25): methylated C nucleotide
  modified_base (27)..(27): methylated C nucleotide
  modified_base (29)..(29): methylated C nucleotide
gccgaggcggggcgggggcgggggcgcgcggttcgcc

SEQ ID NO: 924 - DNA, 27 bp, Artificial Sequence
  Synthetic
  modified_base (6)..(6): methylated C nucleotide
  modified_base (11)..(11): methylated C nucleotide
  modified_base (17)..(17): methylated C nucleotide
  modified_base (23)..(23): methylated C nucleotide
  modified_base (25)..(25): methylated C nucleotide
  modified_base (27)..(27): methylated C nucleotide
cgaggcggggcgggggcgggggcgcgc

SEQ ID NO: 925 - DNA, 27 bp, Artificial Sequence
  Synthetic
  modified_base (9)..(9): methylated C nucleotide
  modified_base (14)..(14): methylated C nucleotide
  modified_base (20)..(20): methylated C nucleotide
ggccgaggcggggcgggggcgggggcg

SEQ ID NO: 926 - DNA, 27 bp, Artificial Sequence
  Synthetic
  modified_base (12)..(12): methylated C nucleotide
  modified_base (17)..(17): methylated C nucleotide
  modified_base (23)..(23): methylated C nucleotide
cggggccgaggcggggcgggggcgggg

SEQ ID NO: 927 - DNA, 27 bp, Artificial Sequence
  Synthetic
  modified_base (15)..(15): methylated C nucleotide
  modified_base (20)..(20): methylated C nucleotide
  modified_base (26)..(26): methylated C nucleotide
ggccggggccgaggcggggcgggggcg

SEQ ID NO: 928 - DNA, 27 bp, Artificial Sequence
  Synthetic
  modified_base (18)..(18): methylated C nucleotide
  modified_base (23)..(23): methylated C nucleotide
cagggccggggccgaggcggggcgggg

SEQ ID NO: 929 - DNA, 27 bp, Artificial Sequence
  Synthetic
  modified_base (5)..(5): methylated C nucleotide
  modified_base (11)..(11): methylated C nucleotide
  modified_base (17)..(17): methylated C nucleotide
  modified_base (19)..(19): methylated C nucleotide
  modified_base (21)..(21): methylated C nucleotide
ggggcgggggcgggggcgcgcggttcg

SEQ ID NO: 930 - DNA, 27 bp, Artificial Sequence
  Synthetic
  modified_base (2)..(2): methylated C nucleotide
  modified_base (8)..(8): methylated C nucleotide
  modified_base (14)..(14): methylated C nucleotide
  modified_base (16)..(16): methylated C nucleotide
  modified_base (18)..(18): methylated C nucleotide
gcgggggcgggggcgcgcggttcgccc

SEQ ID NO: 931 - DNA, 27 bp, Artificial Sequence
  Synthetic
  modified_base (5)..(5): methylated C nucleotide
  modified_base (11)..(11): methylated C nucleotide
  modified_base (13)..(13): methylated C nucleotide
  modified_base (15)..(15): methylated C nucleotide
ggggcgggggcgcgcggttcgccccgc

SEQ ID NO: 932 - DNA, 27 bp, Artificial Sequence
  Synthetic
  modified_base (2)..(2): methylated C nucleotide
  modified_base (8)..(8): methylated C nucleotide
  modified_base (10)..(10): methylated C nucleotide
  modified_base (12)..(12): methylated C nucleotide
gcgggggcgcgcggttcgccccgcgca

SEQ ID NO: 933 - DNA, 27 bp, Artificial Sequence
  Synthetic
  modified_base (5)..(5): methylated C nucleotide
  modified_base (7)..(7): methylated C nucleotide
  modified_base (9)..(9): methylated C nucleotide
ggggcgcgcggttcgccccgcgcatgg

SEQ ID NO: 934 - DNA, 25 bp, Artificial Sequence
  Synthetic
  modified_base (1)..(1): methylated C nucleotide
  modified_base (6)..(6): methylated C nucleotide
  modified_base (12)..(12): methylated C nucleotide
  modified_base (18)..(18): methylated C nucleotide
  modified_base (20)..(20): methylated C nucleotide
  modified_base (22)..(22): methylated C nucleotide
cggggcgggggcgggggcgcgcggt

SEQ ID NO: 935 - DNA, 23 bp, Artificial Sequence
  Synthetic
  modified_base (4)..(4): methylated C nucleotide
  modified_base (10)..(10): methylated C nucleotide
  modified_base (16)..(16): methylated C nucleotide
  modified_base (18)..(18): methylated C nucleotide
  modified_base (20)..(20): methylated C nucleotide
gggcgggggcgggggcgcgcggt

SEQ ID NO: 936 - DNA, 21 bp, Artificial Sequence
  Synthetic
  modified_base (2)..(2): methylated C nucleotide
  modified_base (8)..(8): methylated C nucleotide
  modified_base (14)..(14): methylated C nucleotide
  modified_base (16)..(16): methylated C nucleotide
  modified_base (18)..(18): methylated C nucleotide
gcgggggcgggggcgcgcggt

SEQ ID NO: 937 - DNA, 19 bp, Artificial Sequence
  Synthetic
  modified_base (6)..(6): methylated C nucleotide
  modified_base (12)..(12): methylated C nucleotide
  modified_base (14)..(14): methylated C nucleotide
  modified_base (16)..(16): methylated C nucleotide
gggggcgggggcgcgcggt

SEQ ID NO: 938 - DNA, 17 bp, Artificial Sequence
  Synthetic
  modified_base (4)..(4): methylated C nucleotide
  modified_base (10)..(10): methylated C nucleotide
  modified_base (12)..(12): methylated C nucleotide
  modified_base (14)..(14): methylated C nucleotide
gggcgggggcgcgcggt

SEQ ID NO: 939 - DNA, 15 bp, Artificial Sequence
  Synthetic
  modified_base (2)..(2): methylated C nucleotide
  modified_base (8)..(8): methylated C nucleotide
  modified_base (10)..(10): methylated C nucleotide
  modified_base (12)..(12): methylated C nucleotide
gcgggggcgcgcggt

SEQ ID NO: 940 - DNA, 25 bp, Artificial Sequence
  Synthetic
  modified_base (3)..(3): methylated C nucleotide
  modified_base (8)..(8): methylated C nucleotide
  modified_base (14)..(14): methylated C nucleotide
  modified_base (20)..(20): methylated C nucleotide
  modified_base (24)..(24): methylated C nucleotide
ggcggggcgggggcgggggcgcgcg

SEQ ID NO: 941 - DNA, 23 bp, Artificial Sequence
  Synthetic
  modified_base (3)..(3): methylated C nucleotide
  modified_base (8)..(8): methylated C nucleotide
  modified_base (14)..(14): methylated C nucleotide
  modified_base (20)..(20): methylated C nucleotide
  modified_base (22)..(22): methylated C nucleotide
ggcggggcgggggcgggggcgcg

SEQ ID NO: 942 - DNA, 21 bp, Artificial Sequence
  Synthetic
  modified_base (3)..(3): methylated C nucleotide
  modified_base (8)..(8): methylated C nucleotide
  modified_base (14)..(14): methylated C nucleotide
  modified_base (20)..(20): methylated C nucleotide
ggcggggcgggggcgggggcg

SEQ ID NO: 943 - DNA, 19 bp, Artificial Sequence
  Synthetic
  modified_base (3)..(3): methylated C nucleotide
  modified_base (8)..(8): methylated C nucleotide
  modified_base (14)..(14): methylated C nucleotide
ggcggggcgggggcggggg

SEQ ID NO: 944 - DNA, 17 bp, Artificial Sequence
  Synthetic
  modified_base (3)..(3): methylated C nucleotide
  modified_base (8)..(8): methylated C nucleotide
  modified_base (14)..(14): methylated C nucleotide
ggcggggcgggggcggg

SEQ ID NO: 945 - DNA, 15 bp, Artificial Sequence
  Synthetic
  modified_base (3)..(3): methylated C nucleotide
  modified_base (8)..(8): methylated C nucleotide
  modified_base (14)..(14): methylated C nucleotide
ggcggggcgggggcg

SEQ ID NO: 946 - DNA, 27 bp, Artificial Sequence
  Synthetic
  modified_base (3)..(3): methylated C nucleotide
  modified_base (8)..(8): methylated C nucleotide
  modified_base (14)..(14): methylated C nucleotide
  modified_base (20)..(20): methylated C nucleotide
  modified_base (22)..(22): methylated C nucleotide
  modified_base (24)..(24): methylated C nucleotide
ggcgaggcgggggcgggggcgcgcggt

SEQ ID NO: 947 - DNA, 27 bp, Artificial Sequence
  Synthetic
  modified_base (3)..(3): methylated C nucleotide
  modified_base (8)..(8): methylated C nucleotide
  modified_base (14)..(14): methylated C nucleotide
  modified_base (20)..(20): methylated C nucleotide
  modified_base (22)..(22): methylated C nucleotide
  modified_base (24)..(24): methylated C nucleotide
ggcggggcgggggcgggtgcgcgcggt

SEQ ID NO: 948 - DNA, 27 bp, Artificial Sequence
  Synthetic
  modified_base (3)..(3): methylated C nucleotide
  modified_base (8)..(8): methylated C nucleotide
  modified_base (14)..(14): methylated C nucleotide
  modified_base (20)..(20): methylated C nucleotide
  modified_base (22)..(22): methylated C nucleotide
  modified_base (24)..(24): methylated C nucleotide
ggcggggcgcgggcgggggcgcgcggt

SEQ ID NO: 949 - DNA, 32 bp, Artificial Sequence; identical to SEQ ID NO: 76
  Synthetic
  modified_base (2)..(2): methylated C nucleotide
  modified_base (5)..(5): methylated C nucleotide
  modified_base (8)..(8): methylated C nucleotide
  modified_base (11)..(11): methylated C nucleotide
  modified_base (14)..(14): methylated C nucleotide
  modified_base (17)..(17): methylated C nucleotide
  modified_base (23)..(23): methylated C nucleotide
  modified_base (27)..(27): methylated C nucleotide
  modified_base (30)..(30): methylated C nucleotide

SEQ ID NO: 950 - DNA, 33 bp, Artificial Sequence
  Synthetic
  modified_base (3)..(3): methylated C nucleotide
  modified_base (6)..(6): methylated C nucleotide
  modified_base (9)..(9): methylated C nucleotide
  modified_base (12)..(12): methylated C nucleotide
  modified_base (15)..(15): methylated C nucleotide
  modified_base (18)..(18): methylated C nucleotide
  modified_base (24)..(24): methylated C nucleotide
  modified_base (28)..(28): methylated C nucleotide
  modified_base (31)..(31): methylated C nucleotide
cccgccgccgccgccgccgcttacgcccgccgg

SEQ ID NO: 951 - DNA, 34 bp, Artificial Sequence
  Synthetic
  modified_base (4)..(4): methylated C nucleotide
  modified_base (7)..(7): methylated C nucleotide
  modified_base (10)..(10): methylated C nucleotide
  modified_base (13)..(13): methylated C nucleotide
  modified_base (16)..(16): methylated C nucleotide
  modified_base (19)..(19): methylated C nucleotide
  modified_base (25)..(25): methylated C nucleotide
  modified_base (29)..(29): methylated C nucleotide
  modified_base (32)..(32): methylated C nucleotide
acccgccgccgccgccgccgcttacgcccgccgg

SEQ ID NO: 952 - DNA, 35 bp, Artificial Sequence
  Synthetic
  modified_base (5)..(5): methylated C nucleotide
  modified_base (8)..(8): methylated C nucleotide
  modified_base (11)..(11): methylated C nucleotide
  modified_base (14)..(14): methylated C nucleotide
  modified_base (17)..(17): methylated C nucleotide
  modified_base (20)..(20): methylated C nucleotide
  modified_base (26)..(26): methylated C nucleotide
  modified_base (30)..(30): methylated C nucleotide
  modified_base (33)..(33): methylated C nucleotide
cacccgccgccgccgccgccgcttacgcccgccgg

SEQ ID NO: 953 - DNA, 36 bp, Artificial Sequence
  Synthetic
  modified_base (6)..(6): methylated C nucleotide
  modified_base (9)..(9): methylated C nucleotide
  modified_base (12)..(12): methylated C nucleotide
  modified_base (15)..(15): methylated C nucleotide
  modified_base (18)..(18): methylated C nucleotide
  modified_base (21)..(21): methylated C nucleotide
  modified_base (27)..(27): methylated C nucleotide
  modified_base (31)..(31): methylated C nucleotide
  modified_base (34)..(34): methylated C nucleotide
ccacccgccgccgccgccgccgcttacgcccgccgg

SEQ ID NO: 954 - DNA, 37 bp, Artificial Sequence
  Synthetic
  modified_base (7)..(7): methylated C nucleotide
  modified_base (10)..(10): methylated C nucleotide
  modified_base (13)..(13): methylated C nucleotide
  modified_base (16)..(16): methylated C nucleotide
  modified_base (19)..(19): methylated C nucleotide
  modified_base (22)..(22): methylated C nucleotide
  modified_base (28)..(28): methylated C nucleotide
  modified_base (32)..(32): methylated C nucleotide
  modified_base (35)..(35): methylated C nucleotide
cccacccgccgccgccgccgccgcttacgcccgccgg

SEQ ID NO: 955 - DNA, 33 bp, Artificial Sequence
  Synthetic
  modified_base (2)..(2): methylated C nucleotide
  modified_base (5)..(5): methylated C nucleotide
  modified_base (8)..(8): methylated C nucleotide
  modified_base (11)..(11): methylated C nucleotide
  modified_base (14)..(14): methylated C nucleotide
  modified_base (17)..(17): methylated C nucleotide
  modified_base (23)..(23): methylated C nucleotide
  modified_base (27)..(27): methylated C nucleotide
  modified_base (30)..(30): methylated C nucleotide
ccgccgccgccgccgccgcttacgcccgccggc

SEQ ID NO: 956 - DNA, 34 bp, Artificial Sequence
  Synthetic
  modified_base (2)..(2): methylated C nucleotide
  modified_base (5)..(5): methylated C nucleotide
  modified_base (8)..(8): methylated C nucleotide
  modified_base (11)..(11): methylated C nucleotide
  modified_base (14)..(14): methylated C nucleotide
  modified_base (17)..(17): methylated C nucleotide
  modified_base (23)..(23): methylated C nucleotide
  modified_base (27)..(27): methylated C nucleotide
  modified_base (30)..(30): methylated C nucleotide
ccgccgccgccgccgccgcttacgcccgccggcc

SEQ ID NO: 957 - DNA, 35 bp, Artificial Sequence
  Synthetic
  modified_base (2)..(2): methylated C nucleotide
  modified_base (5)..(5): methylated C nucleotide
  modified_base (8)..(8): methylated C nucleotide
  modified_base (11)..(11): methylated C nucleotide
  modified_base (14)..(14): methylated C nucleotide
  modified_base (17)..(17): methylated C nucleotide
  modified_base (23)..(23): methylated C nucleotide
  modified_base (27)..(27): methylated C nucleotide
  modified_base (30)..(30): methylated C nucleotide
ccgccgccgccgccgccgcttacgcccgccggccc

SEQ ID NO: 958 - DNA, 36 bp, Artificial Sequence
  Synthetic
  modified_base (2)..(2): methylated C nucleotide
  modified_base (5)..(5): methylated C nucleotide
  modified_base (8)..(8): methylated C nucleotide
  modified_base (11)..(11): methylated C nucleotide
  modified_base (14)..(14): methylated C nucleotide
  modified_base (17)..(17): methylated C nucleotide
  modified_base (23)..(23): methylated C nucleotide
  modified_base (27)..(27): methylated C nucleotide
  modified_base (30)..(30): methylated C nucleotide
ccgccgccgccgccgccgcttacgcccgccggcccc

SEQ ID NO: 959 - DNA, 37 bp, Artificial Sequence
  Synthetic
  modified_base (2)..(2): methylated C nucleotide
  modified_base (5)..(5): methylated C nucleotide
  modified_base (8)..(8): methylated C nucleotide
  modified_base (11)..(11): methylated C nucleotide
  modified_base (14)..(14): methylated C nucleotide
  modified_base (17)..(17): methylated C nucleotide
  modified_base (23)..(23): methylated C nucleotide
  modified_base (27)..(27): methylated C nucleotide
  modified_base (30)..(30): methylated C nucleotide
ccgccgccgccgccgccgcttacgcccgccggccccg

SEQ ID NO: 960 - DNA, 34 bp, Artificial Sequence
  Synthetic
  modified_base (3)..(3): methylated C nucleotide
  modified_base (6)..(6): methylated C nucleotide
  modified_base (9)..(9): methylated C nucleotide
  modified_base (12)..(12): methylated C nucleotide
  modified_base (15)..(15): methylated C nucleotide
  modified_base (18)..(18): methylated C nucleotide
  modified_base (24)..(24): methylated C nucleotide
  modified_base (28)..(28): methylated C nucleotide
  modified_base (31)..(31): methylated C nucleotide
cccgccgccgccgccgccgcttacgcccgccggc

SEQ ID NO: 961 - DNA, 36 bp, Artificial Sequence
  Synthetic
  modified_base (4)..(4): methylated C nucleotide
  modified_base (7)..(7): methylated C nucleotide
  modified_base (10)..(10): methylated C nucleotide
  modified_base (13)..(13): methylated C nucleotide
  modified_base (16)..(16): methylated C nucleotide
  modified_base (19)..(19): methylated C nucleotide
  modified_base (25)..(25): methylated C nucleotide
  modified_base (29)..(29): methylated C nucleotide
  modified_base (32)..(32): methylated C nucleotide
acccgccgccgccgccgccgcttacgcccgccggcc

SEQ ID NO: 962 - DNA, 38 bp, Artificial Sequence
  Synthetic
  modified_base (5)..(5): methylated C nucleotide
  modified_base (8)..(8): methylated C nucleotide
  modified_base (11)..(11): methylated C nucleotide
  modified_base (14)..(14): methylated C nucleotide
  modified_base (17)..(17): methylated C nucleotide
  modified_base (20)..(20): methylated C nucleotide
  modified_base (26)..(26): methylated C nucleotide
  modified_base (30)..(30): methylated C nucleotide
  modified_base (33)..(33): methylated C nucleotide
cacccgccgccgccgccgccgcttacgcccgccggccc

SEQ ID NO: 963 - DNA, 40 bp, Artificial Sequence
  Synthetic
  modified_base (6)..(6): methylated C nucleotide
  modified_base (9)..(9): methylated C nucleotide
  modified_base (12)..(12): methylated C nucleotide
  modified_base (15)..(15): methylated C nucleotide
  modified_base (18)..(18): methylated C nucleotide
  modified_base (21)..(21): methylated C nucleotide
  modified_base (27)..(27): methylated C nucleotide
  modified_base (31)..(31): methylated C nucleotide
  modified_base (34)..(34): methylated C nucleotide
ccacccgccgccgccgccgccgcttacgcccgccggcccc

SEQ ID NO: 964 - DNA, 42 bp, Artificial Sequence
  Synthetic
  modified_base (7)..(7): methylated C nucleotide
  modified_base (10)..(10): methylated C nucleotide
  modified_base (13)..(13): methylated C nucleotide
  modified_base (16)..(16): methylated C nucleotide
  modified_base (19)..(19): methylated C nucleotide
  modified_base (22)..(22): methylated C nucleotide
  modified_base (28)..(28): methylated C nucleotide
  modified_base (32)..(32): methylated C nucleotide
  modified_base (35)..(35): methylated C nucleotide
cccacccgccgccgccgccgccgcttacgcccgccggccccg

SEQ ID NO: 965 - DNA, 32 bp, Artificial Sequence
  Synthetic
  modified_base (5)..(5): methylated C nucleotide
  modified_base (8)..(8): methylated C nucleotide
  modified_base (11)..(11): methylated C nucleotide
  modified_base (14)..(14): methylated C nucleotide
  modified_base (17)..(17): methylated C nucleotide
  modified_base (20)..(20): methylated C nucleotide
  modified_base (26)..(26): methylated C nucleotide
  modified_base (30)..(30): methylated C nucleotide
cacccgccgccgccgccgccgcttacgcccgc

SEQ ID NO: 966 - DNA, 32 bp, Artificial Sequence
  Synthetic
  modified_base (8)..(8): methylated C nucleotide
  modified_base (11)..(11): methylated C nucleotide
  modified_base (14)..(14): methylated C nucleotide
  modified_base (17)..(17): methylated C nucleotide
  modified_base (20)..(20): methylated C nucleotide
  modified_base (23)..(23): methylated C nucleotide
  modified_base (29)..(29): methylated C nucleotide
acccacccgccgccgccgccgccgcttacgcc

SEQ ID NO: 967 - DNA, 32 bp, Artificial Sequence
  Synthetic
  modified_base (11)..(11): methylated C nucleotide
  modified_base (14)..(14): methylated C nucleotide
  modified_base (17)..(17): methylated C nucleotide
  modified_base (20)..(20): methylated C nucleotide
  modified_base (23)..(23): methylated C nucleotide
  modified_base (26)..(26): methylated C nucleotide
  modified_base (32)..(32): methylated C nucleotide
cccacccacccgccgccgccgccgccgcttac

SEQ ID NO: 968 - DNA, 32 bp, Artificial Sequence
  Synthetic
  modified_base (14)..(14): methylated C nucleotide
  modified_base (17)..(17): methylated C nucleotide
  modified_base (20)..(20): methylated C nucleotide
  modified_base (23)..(23): methylated C nucleotide
  modified_base (26)..(26): methylated C nucleotide
  modified_base (29)..(29): methylated C nucleotide
ggccccacccacccgccgccgccgccgccgct

SEQ ID NO: 969 - DNA, 32 bp, Artificial Sequence
  Synthetic
  modified_base (17)..(17): methylated C nucleotide
  modified_base (20)..(20): methylated C nucleotide
  modified_base (23)..(23): methylated C nucleotide
  modified_base (26)..(26): methylated C nucleotide
  modified_base (29)..(29): methylated C nucleotide
  modified_base (32)..(32): methylated C nucleotide
cccggccccacccacccgccgccgccgccgcc

SEQ ID NO: 970 - DNA, 32 bp, Artificial Sequence
  Synthetic
  modified_base (2)..(2): methylated C nucleotide
  modified_base (5)..(5): methylated C nucleotide
  modified_base (8)..(8): methylated C nucleotide
  modified_base (11)..(11): methylated C nucleotide
  modified_base (14)..(14): methylated C nucleotide
  modified_base (20)..(20): methylated C nucleotide
  modified_base (24)..(24): methylated C nucleotide
  modified_base (27)..(27): methylated C nucleotide
ccgccgccgccgccgcttacgcccgccggccc

SEQ ID NO: 971 - DNA, 32 bp, Artificial Sequence
  Synthetic
  modified_base (2)..(2): methylated C nucleotide
  modified_base (5)..(5): methylated C nucleotide
  modified_base (8)..(8): methylated C nucleotide
  modified_base (11)..(11): methylated C nucleotide
  modified_base (17)..(17): methylated C nucleotide
  modified_base (21)..(21): methylated C nucleotide
  modified_base (24)..(24): methylated C nucleotide
ccgccgccgccgcttacgcccgccggccccgc

SEQ ID NO: 972 - DNA, 32 bp, Artificial Sequence
  Synthetic
  modified_base (2)..(2): methylated C nucleotide
  modified_base (5)..(5): methylated C nucleotide
  modified_base (8)..(8): methylated C nucleotide
  modified_base (14)..(14): methylated C nucleotide
  modified_base (18)..(18): methylated C nucleotide
  modified_base (21)..(21): methylated C nucleotide
ccgccgccgcttacgcccgccggccccgcgcc

SEQ ID NO: 973 - DNA, 32 bp, Artificial Sequence
  Synthetic
  modified_base (2)..(2): methylated C nucleotide
  modified_base (5)..(5): methylated C nucleotide
  modified_base (11)..(11): methylated C nucleotide
  modified_base (15)..(15): methylated C nucleotide
  modified_base (18)..(18): methylated C nucleotide
ccgccgcttacgcccgccggccccgcgccccc

SEQ ID NO: 974 - DNA, 32 bp, Artificial Sequence
  Synthetic
  modified_base (2)..(2): methylated C nucleotide
  modified_base (8)..(8): methylated C nucleotide
  modified_base (12)..(12): methylated C nucleotide
  modified_base (15)..(15): methylated C nucleotide
ccgcttacgcccgccggccccgcgcccccggc

SEQ ID NO: 975 - DNA, 30 bp, Artificial Sequence
  Synthetic
  modified_base (3)..(3): methylated C nucleotide
  modified_base (6)..(6): methylated C nucleotide
  modified_base (9)..(9): methylated C nucleotide
  modified_base (12)..(12): methylated C nucleotide
  modified_base (15)..(15): methylated C nucleotide
  modified_base (21)..(21): methylated C nucleotide
  modified_base (25)..(25): methylated C nucleotide
  modified_base (28)..(28): methylated C nucleotide
gccgccgccgccgccgcttacgcccgccgg

SEQ ID NO: 976 - DNA, 28 bp, Artificial Sequence
  Synthetic
  modified_base (1)..(1): methylated C nucleotide
  modified_base (4)..(4): methylated C nucleotide
  modified_base (7)..(7): methylated C nucleotide
  modified_base (10)..(10): methylated C nucleotide
  modified_base (13)..(13): methylated C nucleotide
  modified_base (19)..(19): methylated C nucleotide
  modified_base (23)..(23): methylated C nucleotide
  modified_base (26)..(26): methylated C nucleotide
cgccgccgccgccgcttacgcccgccgg

SEQ ID NO: 977 - DNA, 26 bp, Artificial Sequence
  Synthetic
  modified_base (2)..(2): methylated C nucleotide
  modified_base (5)..(5): methylated C nucleotide
  modified_base (8)..(8): methylated C nucleotide
  modified_base (11)..(11): methylated C nucleotide
  modified_base (17)..(17): methylated C nucleotide
  modified_base (21)..(21): methylated C nucleotide
  modified_base (24)..(24): methylated C nucleotide
ccgccgccgccgcttacgcccgccgg

SEQ ID NO: 978 - DNA, 24 bp, Artificial Sequence
  Synthetic
  modified_base (3)..(3): methylated C nucleotide
  modified_base (6)..(6): methylated C nucleotide
  modified_base (9)..(9): methylated C nucleotide
  modified_base (15)..(15): methylated C nucleotide
  modified_base (19)..(19): methylated C nucleotide
  modified_base (22)..(22): methylated C nucleotide
gccgccgccgcttacgcccgccgg

SEQ ID NO: 979 - DNA, 22 bp, Artificial Sequence
  Synthetic
  modified_base (1)..(1): methylated C nucleotide
  modified_base (4)..(4): methylated C nucleotide
  modified_base (7)..(7): methylated C nucleotide
  modified_base (13)..(13): methylated C nucleotide
  modified_base (17)..(17): methylated C nucleotide
  modified_base (20)..(20): methylated C nucleotide
cgccgccgcttacgcccgccgg

SEQ ID NO: 980 - DNA, 20 bp, Artificial Sequence
  Synthetic
  modified_base (2)..(2): methylated C nucleotide
  modified_base (5)..(5): methylated C nucleotide
  modified_base (11)..(11): methylated C nucleotide
  modified_base (15)..(15): methylated C nucleotide
  modified_base (18)..(18): methylated C nucleotide
ccgccgcttacgcccgccgg

SEQ ID NO: 981 - DNA, 18 bp, Artificial Sequence
  Synthetic
  modified_base (3)..(3): methylated C nucleotide
  modified_base (9)..(9): methylated C nucleotide
  modified_base (13)..(13): methylated C nucleotide
  modified_base (16)..(16): methylated C nucleotide
gccgcttacgcccgccgg

SEQ ID NO: 982 - DNA, 16 bp, Artificial Sequence
  Synthetic
  modified_base (1)..(1): methylated C nucleotide
  modified_base (7)..(7): methylated C nucleotide
  modified_base (11)..(11): methylated C nucleotide
  modified_base (14)..(14): methylated C nucleotide
cgcttacgcccgccgg

SEQ ID NO: 983 - DNA, 15 bp, Artificial Sequence
  Synthetic
  modified_base (6)..(6): methylated C nucleotide
  modified_base (10)..(10): methylated C nucleotide
  modified_base (13)..(13): methylated C nucleotide
gcttacgcccgccgg

SEQ ID NO: 984 - DNA, 30 bp, Artificial Sequence
  Synthetic
  modified_base (2)..(2): methylated C nucleotide
  modified_base (5)..(5): methylated C nucleotide
  modified_base (8)..(8): methylated C nucleotide
  modified_base (11)..(11): methylated C nucleotide
  modified_base (14)..(14): methylated C nucleotide
  modified_base (17)..(17): methylated C nucleotide
  modified_base (23)..(23): methylated C nucleotide
  modified_base (27)..(27): methylated C nucleotide
  modified_base (30)..(30): methylated C nucleotide
ccgccgccgccgccgccgcttacgcccgcc

SEQ ID NO: 985 - DNA, 28 bp, Artificial Sequence
  Synthetic
  modified_base (2)..(2): methylated C nucleotide
  modified_base (5)..(5): methylated C nucleotide
  modified_base (8)..(8): methylated C nucleotide
  modified_base (11)..(11): methylated C nucleotide
  modified_base (14)..(14): methylated C nucleotide
  modified_base (17)..(17): methylated C nucleotide
  modified_base (23)..(23): methylated C nucleotide
  modified_base (27)..(27): methylated C nucleotide
ccgccgccgccgccgccgcttacgcccg

SEQ ID NO: 986 - DNA, 26 bp, Artificial Sequence
  Synthetic
  modified_base (2)..(2): methylated C nucleotide
  modified_base (5)..(5): methylated C nucleotide
  modified_base (8)..(8): methylated C nucleotide
  modified_base (11)..(11): methylated C nucleotide
  modified_base (14)..(14): methylated C nucleotide
  modified_base (17)..(17): methylated C nucleotide
  modified_base (23)..(23): methylated C nucleotide
ccgccgccgccgccgccgcttacgcc

SEQ ID NO: 987 - DNA, 24 bp, Artificial Sequence
  Synthetic
  modified_base (2)..(2): methylated C nucleotide
  modified_base (5)..(5): methylated C nucleotide
  modified_base (8)..(8): methylated C nucleotide
  modified_base (11)..(11): methylated C nucleotide
  modified_base (14)..(14): methylated C nucleotide
  modified_base (17)..(17): methylated C nucleotide
  modified_base (23)..(23): methylated C nucleotide
ccgccgccgccgccgccgcttacg

SEQ ID NO: 988 - DNA, 22 bp, Artificial Sequence
  Synthetic
  modified_base (2)..(2): methylated C nucleotide
  modified_base (5)..(5): methylated C nucleotide
  modified_base (8)..(8): methylated C nucleotide
  modified_base (11)..(11): methylated C nucleotide
  modified_base (14)..(14): methylated C nucleotide
  modified_base (17)..(17): methylated C nucleotide
ccgccgccgccgccgccgctta

SEQ ID NO: 989 - DNA, 20 bp, Artificial Sequence
  Synthetic
  modified_base (2)..(2): methylated C nucleotide
  modified_base (5)..(5): methylated C nucleotide
  modified_base (8)..(8): methylated C nucleotide
  modified_base (11)..(11): methylated C nucleotide
  modified_base (14)..(14): methylated C nucleotide
  modified_base (17)..(17): methylated C nucleotide
ccgccgccgccgccgccgct

SEQ ID NO: 990 - DNA, 18 bp, Artificial Sequence
  Synthetic
  modified_base (2)..(2): methylated C nucleotide
  modified_base (5)..(5): methylated C nucleotide
  modified_base (8)..(8): methylated C nucleotide
  modified_base (11)..(11): methylated C nucleotide
  modified_base (14)..(14): methylated C nucleotide
  modified_base (17)..(17): methylated C nucleotide
ccgccgccgccgccgccg

SEQ ID NO: 991 - DNA, 16 bp, Artificial Sequence
  Synthetic
  modified_base (2)..(2): methylated C nucleotide
  modified_base (5)..(5): methylated C nucleotide
  modified_base (8)..(8): methylated C nucleotide
  modified_base (11)..(11): methylated C nucleotide
  modified_base (14)..(14): methylated C nucleotide
ccgccgccgccgccgc

SEQ ID NO: 992 - DNA, 15 bp, Artificial Sequence
  Synthetic
  modified_base (2)..(2): methylated C nucleotide
  modified_base (5)..(5): methylated C nucleotide
  modified_base (8)..(8): methylated C nucleotide
  modified_base (11)..(11): methylated C nucleotide
  modified_base (14)..(14): methylated C nucleotide
ccgccgccgccgccg

SEQ ID NO: 993 - DNA, 32 bp, Artificial Sequence
  Synthetic
  modified_base (2)..(2): methylated C nucleotide
  modified_base (5)..(5): methylated C nucleotide
  modified_base (8)..(8): methylated C nucleotide
  modified_base (11)..(11): methylated C nucleotide
  modified_base (14)..(14): methylated C nucleotide
  modified_base (17)..(17): methylated C nucleotide
  modified_base (23)..(23): methylated C nucleotide
  modified_base (27)..(27): methylated C nucleotide
  modified_base (30)..(30): methylated C nucleotide
ccgccgccaccgccgccgcttacgcccgccgg

SEQ ID NO: 994 - DNA, 32 bp, Artificial Sequence
  Synthetic
  modified_base (2)..(2): methylated C nucleotide
  modified_base (5)..(5): methylated C nucleotide
  modified_base (8)..(8): methylated C nucleotide
  modified_base (11)..(11): methylated C nucleotide
  modified_base (14)..(14): methylated C nucleotide
  modified_base (17)..(17): methylated C nucleotide
  modified_base (23)..(23): methylated C nucleotide
  modified_base (27)..(27): methylated C nucleotide
  modified_base (30)..(30): methylated C nucleotide
ccgccgccgccgccgccgcttccgcccgccgg

SEQ ID NO: 995 - DNA, 32 bp, Artificial Sequence
  Synthetic
  modified_base (2)..(2): methylated C nucleotide
  modified_base (5)..(5): methylated C nucleotide
  modified_base (8)..(8): methylated C nucleotide
  modified_base (11)..(11): methylated C nucleotide
  modified_base (14)..(14): methylated C nucleotide
  modified_base (17)..(17): methylated C nucleotide
  modified_base (23)..(23): methylated C nucleotide
  modified_base (27)..(27): methylated C nucleotide
  modified_base (30)..(30): methylated C nucleotide
ccgccgccgccgccaccgcttacgcccgccgg

SEQ ID NO: 996 - DNA, 28 bp, Artificial Sequence
  Synthetic
  modified_base (2)..(2): methylated C nucleotide
  modified_base (6)..(6): methylated C nucleotide
  modified_base (9)..(9): methylated C nucleotide
  modified_base (18)..(18): methylated C nucleotide
  modified_base (21)..(21): methylated C nucleotide
  modified_base (25)..(25): methylated C nucleotide
ccgcccgccgcagcccccgacgcccgct

SEQ ID NO: 997 - DNA, 29 bp, Artificial Sequence
  Synthetic
  modified_base (3)..(3): methylated C nucleotide
  modified_base (7)..(7): methylated C nucleotide
  modified_base (10)..(10): methylated C nucleotide
  modified_base (19)..(19): methylated C nucleotide
  modified_base (22)..(22): methylated C nucleotide
  modified_base (26)..(26): methylated C nucleotide
cccgcccgccgcagcccccgacgcccgct

SEQ ID NO: 998 - DNA, 30 bp, Artificial Sequence
  Synthetic
  modified_base (4)..(4): methylated C nucleotide
  modified_base (8)..(8): methylated C nucleotide
  modified_base (11)..(11): methylated C nucleotide
  modified_base (20)..(20): methylated C nucleotide
  modified_base (23)..(23): methylated C nucleotide
  modified_base (27)..(27): methylated C nucleotide
ccccgcccgccgcagcccccgacgcccgct

SEQ ID NO: 999 - DNA, 31 bp, Artificial Sequence
  Synthetic
  modified_base (5)..(5): methylated C nucleotide
  modified_base (9)..(9): methylated C nucleotide
  modified_base (12)..(12): methylated C nucleotide
  modified_base (21)..(21): methylated C nucleotide
  modified_base (24)..(24): methylated C nucleotide
  modified_base (28)..(28): methylated C nucleotide
cccccgcccgccgcagcccccgacgcccgct

SEQ ID NO: 1000 - DNA, 32 bp, Artificial Sequence
  Synthetic
  modified_base (6)..(6): methylated C nucleotide
  modified_base (10)..(10): methylated C nucleotide
  modified_base (13)..(13): methylated C nucleotide
  modified_base (22)..(22): methylated C nucleotide
  modified_base (25)..(25): methylated C nucleotide
  modified_base (29)..(29): methylated C nucleotide
gcccccgcccgccgcagcccccgacgcccgct

SEQ ID NO: 1001 - DNA, 33 bp, Artificial Sequence
  Synthetic
  modified_base (7)..(7): methylated C nucleotide
  modified_base (11)..(11): methylated C nucleotide
  modified_base (14)..(14): methylated C nucleotide
  modified_base (23)..(23): methylated C nucleotide
  modified_base (26)..(26): methylated C nucleotide
  modified_base (30)..(30): methylated C nucleotide
ggcccccgcccgccgcagcccccgacgcccgct

SEQ ID NO: 1002 - DNA, 29 bp, Artificial Sequence
  Synthetic
  modified_base (2)..(2): methylated C nucleotide
  modified_base (6)..(6): methylated C nucleotide
  modified_base (9)..(9): methylated C nucleotide
  modified_base (18)..(18): methylated C nucleotide
  modified_base (21)..(21): methylated C nucleotide
  modified_base (25)..(25): methylated C nucleotide
ccgcccgccgcagcccccgacgcccgctc

SEQ ID NO: 1003 - DNA, 30 bp, Artificial Sequence
  Synthetic
  modified_base (2)..(2): methylated C nucleotide
  modified_base (6)..(6): methylated C nucleotide
  modified_base (9)..(9): methylated C nucleotide
  modified_base (18)..(18): methylated C nucleotide
  modified_base (21)..(21): methylated C nucleotide
  modified_base (25)..(25): methylated C nucleotide
ccgcccgccgcagcccccgacgcccgctca

SEQ ID NO: 1004 - DNA, 31 bp, Artificial Sequence
  Synthetic
  modified_base (2)..(2): methylated C nucleotide
  modified_base (6)..(6): methylated C nucleotide
  modified_base (9)..(9): methylated C nucleotide
  modified_base (18)..(18): methylated C nucleotide
  modified_base (25)..(25): methylated C nucleotide
ccgcccgccgcagcccccgacgcccgctcac

SEQ ID NO: 1005 - DNA, 32 bp, Artificial Sequence
  Synthetic
  modified_base (2)..(2): methylated C nucleotide
  modified_base (6)..(6): methylated C nucleotide
  modified_base (9)..(9): methylated C nucleotide
  modified_base (18)..(18): methylated C nucleotide
  modified_base (21)..(21): methylated C nucleotide
  modified_base (25)..(25): methylated C nucleotide
ccgcccgccgcagcccccgacgcccgctcacc

SEQ ID NO: 1006 - DNA, 33 bp, Artificial Sequence
  Synthetic
  modified_base (2)..(2): methylated C nucleotide
  modified_base (6)..(6): methylated C nucleotide
  modified_base (9)..(9): methylated C nucleotide
  modified_base (18)..(18): methylated C nucleotide
  modified_base (21)..(21): methylated C nucleotide
  modified_base (25)..(25): methylated C nucleotide
ccgcccgccgcagcccccgacgcccgctcacct

SEQ ID NO: 1007 - DNA, 30 bp, Artificial Sequence
  Synthetic
  modified_base (3)..(3): methylated C nucleotide
  modified_base (7)..(7): methylated C nucleotide
  modified_base (10)..(10): methylated C nucleotide
  modified_base (19)..(19): methylated C nucleotide
  modified_base (22)..(22): methylated C nucleotide
  modified_base (26)..(26): methylated C nucleotide
cccgcccgccgcagcccccgacgcccgctc

SEQ ID NO: 1008 - DNA, 32 bp, Artificial Sequence
  Synthetic
  modified_base (4)..(4): methylated C nucleotide
  modified_base (8)..(8): methylated C nucleotide
  modified_base (11)..(11): methylated C nucleotide
  modified_base (20)..(20): methylated C nucleotide
  modified_base (23)..(23): methylated C nucleotide
  modified_base (27)..(27): methylated C nucleotide
ccccgcccgccgcagcccccgacgcccgctca

SEQ ID NO: 1009 - DNA, 34 bp, Artificial Sequence
  Synthetic
  modified_base (5)..(5): methylated C nucleotide
  modified_base (9)..(9): methylated C nucleotide
  modified_base (12)..(12): methylated C nucleotide
  modified_base (21)..(21): methylated C nucleotide
  modified_base (24)..(24): methylated C nucleotide
  modified_base (28)..(28): methylated C nucleotide
cccccgcccgccgcagcccccgacgcccgctcac

SEQ ID NO: 1010 - DNA, 36 bp, Artificial Sequence
  Synthetic
  modified_base (6)..(6): methylated C nucleotide
  modified_base (10)..(10): methylated C nucleotide
  modified_base (13)..(13): methylated C nucleotide
  modified_base (22)..(22): methylated C nucleotide
  modified_base (25)..(25): methylated C nucleotide
  modified_base (29)..(29): methylated C nucleotide
gcccccgcccgccgcagcccccgacgcccgctcacc

SEQ ID NO: 1011 - DNA, 38 bp, Artificial Sequence
  Synthetic
  modified_base (7)..(7): methylated C nucleotide
  modified_base (11)..(11): methylated C nucleotide
  modified_base (14)..(14): methylated C nucleotide
  modified_base (23)..(23): methylated C nucleotide
  modified_base (26)..(26): methylated C nucleotide
  modified_base (30)..(30): methylated C nucleotide
ggcccccgcccgccgcagcccccgacgcccgctcacct

SEQ ID NO: 1012 - DNA, 28 bp, Artificial Sequence
  Synthetic
  modified_base (5)..(5): methylated C nucleotide
  modified_base (9)..(9): methylated C nucleotide
  modified_base (12)..(12): methylated C nucleotide
  modified_base (21)..(21): methylated C nucleotide
  modified_base (24)..(24): methylated C nucleotide
  modified_base (28)..(28): methylated C nucleotide
cccccgcccgccgcagcccccgacgccc

SEQ ID NO: 1013 - DNA, 28 bp, Artificial Sequence
  Synthetic
  modified_base (8)..(8): methylated C nucleotide
  modified_base (12)..(12): methylated C nucleotide
  modified_base (15)..(15): methylated C nucleotide
  modified_base (24)..(24): methylated C nucleotide
  modified_base (27)..(27): methylated C nucleotide
gggcccccgcccgccgcagcccccgacg

SEQ ID NO: 1014 - DNA, 28 bp, Artificial Sequence
  Synthetic
  modified_base (11)..(11): methylated C nucleotide
  modified_base (15)..(15): methylated C nucleotide
  modified_base (18)..(18): methylated C nucleotide
  modified_base (27)..(27): methylated C nucleotide
aaggggcccccgcccgccgcagcccccg

SEQ ID NO: 1015 - DNA, 28 bp, Artificial Sequence
  Synthetic
  modified_base (14)..(14): methylated C nucleotide
  modified_base (18)..(18): methylated C nucleotide
  modified_base (21)..(21): methylated C nucleotide
aggaaggggcccccgcccgccgcagccc

SEQ ID NO: 1016 - DNA, 28 bp, Artificial Sequence
  Synthetic
  modified_base (17)..(17): methylated C nucleotide
  modified_base (21)..(21): methylated C nucleotide
  modified_base (24)..(24): methylated C nucleotide
gggaggaaggggcccccgcccgccgcag

SEQ ID NO: 1017 - DNA, 28 bp, Artificial Sequence
  Synthetic
  modified_base (3)..(3): methylated C nucleotide
  modified_base (6)..(6): methylated C nucleotide
  modified_base (15)..(15): methylated C nucleotide
  modified_base (18)..(18): methylated C nucleotide
  modified_base (22)..(22): methylated C nucleotide
cccgccgcagcccccgacgcccgctcac

SEQ ID NO: 1018 - DNA, 28 bp, Artificial Sequence
  Synthetic
  modified_base (3)..(3): methylated C nucleotide
  modified_base (12)..(12): methylated C nucleotide
  modified_base (15)..(15): methylated C nucleotide
  modified_base (19)..(19): methylated C nucleotide
gccgcagcccccgacgcccgctcacctg

SEQ ID NO: 1019 - DNA, 28 bp, Artificial Sequence
  Synthetic
  modified_base (9)..(9): methylated C nucleotide
  modified_base (12)..(12): methylated C nucleotide
  modified_base (16)..(16): methylated C nucleotide
gcagcccccgacgcccgctcacctgtgc

SEQ ID NO: 1020 - DNA, 28 bp, Artificial Sequence
  Synthetic
  modified_base (6)..(6): methylated C nucleotide
  modified_base (9)..(9): methylated C nucleotide
  modified_base (13)..(13): methylated C nucleotide
gcccccgacgcccgctcacctgtgcccg

SEQ ID NO: 1021 - DNA, 28 bp, Artificial Sequence
  Synthetic
  modified_base (3)..(3): methylated C nucleotide
  modified_base (6)..(6): methylated C nucleotide
  modified_base (10)..(10): methylated C nucleotide
cccgacgcccgctcacctgtgcccgcgg

SEQ ID NO: 1022 - DNA, 26 bp, Artificial Sequence
  Synthetic
  modified_base (4)..(4): methylated C nucleotide
  modified_base (7)..(7): methylated C nucleotide
  modified_base (16)..(16): methylated C nucleotide
  modified_base (19)..(19): methylated C nucleotide
  modified_base (23)..(23): methylated C nucleotide
gcccgccgcagcccccgacgcccgct

SEQ ID NO: 1023 - DNA, 24 bp, Artificial Sequence
  Synthetic
  modified_base (2)..(2): methylated C nucleotide
  modified_base (5)..(5): methylated C nucleotide
  modified_base (14)..(14): methylated C nucleotide
  modified_base (17)..(17): methylated C nucleotide
  modified_base (21)..(21): methylated C nucleotide
ccgccgcagcccccgacgcccgct

SEQ ID NO: 1024 - DNA, 22 bp, Artificial Sequence
  Synthetic
  modified_base (3)..(3): methylated C nucleotide
  modified_base (12)..(12): methylated C nucleotide
  modified_base (15)..(15): methylated C nucleotide
  modified_base (19)..(19): methylated C nucleotide
gccgcagcccccgacgcccgct

SEQ ID NO: 1025 - DNA, 20 bp, Artificial Sequence
  Synthetic
  modified_base (1)..(1): methylated C nucleotide
  modified_base (10)..(10): methylated C nucleotide
  modified_base (13)..(13): methylated C nucleotide
  modified_base (17)..(17): methylated C nucleotide
cgcagcccccgacgcccgct

SEQ ID NO: 1026 - DNA, 18 bp, Artificial Sequence
  Synthetic
  modified_base (8)..(8): methylated C nucleotide
  modified_base (11)..(11): methylated C nucleotide
  modified_base (15)..(15): methylated C nucleotide
cagcccccgacgcccgct

SEQ ID NO: 1027 - DNA, 16 bp, Artificial Sequence
  Synthetic
  modified_base (6)..(6): methylated C nucleotide
  modified_base (9)..(9): methylated C nucleotide
  modified_base (13)..(13): methylated C nucleotide
gcccccgacgcccgct

SEQ ID NO: 1028 - DNA, 15 bp, Artificial Sequence
  Synthetic
  modified_base (5)..(5): methylated C nucleotide
  modified_base (8)..(8): methylated C nucleotide
  modified_base (12)..(12): methylated C nucleotide
cccccgacgcccgct

SEQ ID NO: 1029 - DNA, 26 bp, Artificial Sequence
  Synthetic
  modified_base (2)..(2): methylated C nucleotide
  modified_base (6)..(6): methylated C nucleotide
  modified_base (9)..(9): methylated C nucleotide
  modified_base (18)..(18): methylated C nucleotide
  modified_base (21)..(21): methylated C nucleotide
  modified_base (25)..(25): methylated C nucleotide
ccgcccgccgcagcccccgacgcccg

SEQ ID NO: 1030 - DNA, 24 bp, Artificial Sequence
  Synthetic
  modified_base (2)..(2): methylated C nucleotide
  modified_base (6)..(6): methylated C nucleotide
  modified_base (9)..(9): methylated C nucleotide
  modified_base (18)..(18): methylated C nucleotide
  modified_base (21)..(21): methylated C nucleotide
ccgcccgccgcagcccccgacgcc

SEQ ID NO: 1031 - DNA, 22 bp, Artificial Sequence
  Synthetic
  modified_base (2)..(2): methylated C nucleotide
  modified_base (6)..(6): methylated C nucleotide
  modified_base (9)..(9): methylated C nucleotide
  modified_base (18)..(18): methylated C nucleotide
  modified_base (21)..(21): methylated C nucleotide
ccgcccgccgcagcccccgacg

SEQ ID NO: 1032 - DNA, 20 bp, Artificial Sequence
  Synthetic
  modified_base (2)..(2): methylated C nucleotide
  modified_base (6)..(6): methylated C nucleotide
  modified_base (9)..(9): methylated C nucleotide
  modified_base (18)..(18): methylated C nucleotide
ccgcccgccgcagcccccga

SEQ ID NO: 1033 - DNA, 18 bp, Artificial Sequence
  Synthetic
  modified_base (2)..(2): methylated C nucleotide
  modified_base (6)..(6): methylated C nucleotide
  modified_base (9)..(9): methylated C nucleotide
  modified_base (18)..(18): methylated C nucleotide
ccgcccgccgcagccccc

SEQ ID NO: 1034 - DNA, 16 bp, Artificial Sequence
  Synthetic
  modified_base (2)..(2): methylated C nucleotide
  modified_base (6)..(6): methylated C nucleotide
  modified_base (9)..(9): methylated C nucleotide
ccgcccgccgcagccc

SEQ ID NO: 1035 - DNA, 15 bp, Artificial Sequence
  Synthetic
  modified_base (2)..(2): methylated C nucleotide
  modified_base (6)..(6): methylated C nucleotide
  modified_base (9)..(9): methylated C nucleotide
ccgcccgccgcagcc

SEQ ID NO: 1036 - DNA, 28 bp, Artificial Sequence
  Synthetic
  modified_base (2)..(2): methylated C nucleotide
  modified_base (6)..(6): methylated C nucleotide
  modified_base (9)..(9): methylated C nucleotide
  modified_base (18)..(18): methylated C nucleotide
  modified_base (21)..(21): methylated C nucleotide
  modified_base (25)..(25): methylated C nucleotide
ccgcacgccgcagcccccgacgcccgct

SEQ ID NO: 1037 - DNA, 28 bp, Artificial Sequence
  Synthetic
  modified_base (2)..(2): methylated C nucleotide
  modified_base (6)..(6): methylated C nucleotide
  modified_base (9)..(9): methylated C nucleotide
  modified_base (18)..(18): methylated C nucleotide
  modified_base (21)..(21): methylated C nucleotide
  modified_base (25)..(25): methylated C nucleotide
ccgcccgccgcagccctcgacgcccgct

SEQ ID NO: 1038 - DNA, 28 bp, Artificial Sequence
  Synthetic
  modified_base (2)..(2): methylated C nucleotide
  modified_base (6)..(6): methylated C nucleotide
  modified_base (9)..(9): methylated C nucleotide
  modified_base (18)..(18): methylated C nucleotide
  modified_base (21)..(21): methylated C nucleotide
  modified_base (25)..(25): methylated C nucleotide
ccgcccgccgcagcgcccgacgcccgct

SEQ ID NO: 1039 - DNA, 29 bp, Artificial Sequence
  Synthetic
  modified_base (2)..(2): methylated C nucleotide
  modified_base (4)..(4): methylated C nucleotide
  modified_base (10)..(10): methylated C nucleotide
  modified_base (17)..(17): methylated C nucleotide
  modified_base (27)..(27): methylated C nucleotide
gcgcgccatcgggccccgccccaccccgg

SEQ ID NO: 1040 - DNA, 30 bp, Artificial Sequence
  Synthetic
  modified_base (3)..(3): methylated C nucleotide
  modified_base (5)..(5): methylated C nucleotide
  modified_base (11)..(11): methylated C nucleotide
  modified_base (18)..(18): methylated C nucleotide
  modified_base (28)..(28): methylated C nucleotide
tgcgcgccatcgggccccgccccaccccgg

SEQ ID NO: 1041 - DNA, 31 bp, Artificial Sequence
  Synthetic
  modified_base (4)..(4): methylated C nucleotide
  modified_base (6)..(6): methylated C nucleotide
  modified_base (12)..(12): methylated C nucleotide
  modified_base (19)..(19): methylated C nucleotide
  modified_base (29)..(29): methylated C nucleotide
ctgcgcgccatcgggccccgccccaccccgg

SEQ ID NO: 1042 - DNA, 32 bp, Artificial Sequence
  Synthetic
  modified_base (5)..(5): methylated C nucleotide
  modified_base (7)..(7): methylated C nucleotide
  modified_base (13)..(13): methylated C nucleotide
  modified_base (20)..(20): methylated C nucleotide
  modified_base (30)..(30): methylated C nucleotide
gctgcgcgccatcgggccccgccccaccccgg

SEQ ID NO: 1043 - DNA, 33 bp, Artificial Sequence
  Synthetic
  modified_base (6)..(6): methylated C nucleotide
  modified_base (8)..(8): methylated C nucleotide
  modified_base (14)..(14): methylated C nucleotide
  modified_base (21)..(21): methylated C nucleotide
  modified_base (31)..(31): methylated C nucleotide
ggctgcgcgccatcgggccccgccccaccccgg

SEQ ID NO: 1044 - DNA, 34 bp, Artificial Sequence
  Synthetic
  modified_base (7)..(7): methylated C nucleotide
  modified_base (9)..(9): methylated C nucleotide
  modified_base (15)..(15): methylated C nucleotide
  modified_base (22)..(22): methylated C nucleotide
  modified_base (32)..(32): methylated C nucleotide
tggctgcgcgccatcgggccccgccccaccccgg

SEQ ID NO: 1045 - DNA, 30 bp, Artificial Sequence
  Synthetic
  modified_base (2)..(2): methylated C nucleotide
  modified_base (4)..(4): methylated C nucleotide
  modified_base (10)..(10): methylated C nucleotide
  modified_base (17)..(17): methylated C nucleotide
  modified_base (27)..(27): methylated C nucleotide
gcgcgccatcgggccccgccccaccccggt

SEQ ID NO: 1046 - DNA, 31 bp, Artificial Sequence
  Synthetic
  modified_base (2)..(2): methylated C nucleotide
  modified_base (4)..(4): methylated C nucleotide
  modified_base (10)..(10): methylated C nucleotide
  modified_base (17)..(17): methylated C nucleotide
  modified_base (27)..(27): methylated C nucleotide
gcgcgccatcgggccccgccccaccccggtt

SEQ ID NO: 1047 - DNA, 32 bp, Artificial Sequence
  Synthetic
  modified_base (2)..(2): methylated C nucleotide
  modified_base (4)..(4): methylated C nucleotide
  modified_base (10)..(10): methylated C nucleotide
  modified_base (17)..(17): methylated C nucleotide
  modified_base (27)..(27): methylated C nucleotide
gcgcgccatcgggccccgccccaccccggttg

SEQ ID NO: 1048 - DNA, 33 bp, Artificial Sequence
  Synthetic
  modified_base (2)..(2): methylated C nucleotide
  modified_base (4)..(4): methylated C nucleotide
  modified_base (10)..(10): methylated C nucleotide
  modified_base (17)..(17): methylated C nucleotide
  modified_base (27)..(27): methylated C nucleotide
gcgcgccatcgggccccgccccaccccggttgg

SEQ ID NO: 1049 - DNA, 34 bp, Artificial Sequence
  Synthetic
  modified_base (2)..(2): methylated C nucleotide
  modified_base (4)..(4): methylated C nucleotide
  modified_base (10)..(10): methylated C nucleotide
  modified_base (17)..(17): methylated C nucleotide
  modified_base (27)..(27): methylated C nucleotide
gcgcgccatcgggccccgccccaccccggttggc

SEQ ID NO: 1050 - DNA, 31 bp, Artificial Sequence
  Synthetic
  modified_base (3)..(3): methylated C nucleotide
  modified_base (5)..(5): methylated C nucleotide
  modified_base (11)..(11): methylated C nucleotide
  modified_base (18)..(18): methylated C nucleotide
  modified_base (28)..(28): methylated C nucleotide
tgcgcgccatcgggccccgccccaccccggt

SEQ ID NO: 1051 - DNA, 33 bp, Artificial Sequence
  Synthetic
  modified_base (4)..(4): methylated C nucleotide
  modified_base (6)..(6): methylated C nucleotide
  modified_base (12)..(12): methylated C nucleotide
  modified_base (19)..(19): methylated C nucleotide
  modified_base (29)..(29): methylated C nucleotide
ctgcgcgccatcgggccccgccccaccccggtt

SEQ ID NO: 1052 - DNA, 35 bp, Artificial Sequence
  Synthetic
  modified_base (5)..(5): methylated C nucleotide
  modified_base (7)..(7): methylated C nucleotide
  modified_base (13)..(13): methylated C nucleotide
  modified_base (20)..(20): methylated C nucleotide
  modified_base (30)..(30): methylated C nucleotide
gctgcgcgccatcgggccccgccccaccccggttg

SEQ ID NO: 1053 - DNA, 37 bp, Artificial Sequence
  Synthetic
  modified_base (6)..(6): methylated C nucleotide
  modified_base (8)..(8): methylated C nucleotide
  modified_base (14)..(14): methylated C nucleotide
  modified_base (21)..(21): methylated C nucleotide
  modified_base (31)..(31): methylated C nucleotide
ggctgcgcgccatcgggccccgccccaccccggttgg

SEQ ID NO: 1054 - DNA, 39 bp, Artificial Sequence
  Synthetic
  modified_base (7)..(7): methylated C nucleotide
  modified_base (9)..(9): methylated C nucleotide
  modified_base (15)..(15): methylated C nucleotide
  modified_base (22)..(22): methylated C nucleotide
  modified_base (32)..(32): methylated C nucleotide
tggctgcgcgccatcgggccccgccccaccccggttggc

SEQ ID NO: 1055 - DNA, 29 bp, Artificial Sequence
  Synthetic
  modified_base (5)..(5): methylated C nucleotide
  modified_base (7)..(7): methylated C nucleotide
  modified_base (13)..(13): methylated C nucleotide
  modified_base (20)..(20): methylated C nucleotide
gctgcgcgccatcgggccccgccccaccc

SEQ ID NO: 1056 - DNA, 29 bp, Artificial Sequence
  Synthetic
  modified_base (8)..(8): methylated C nucleotide
  modified_base (10)..(10): methylated C nucleotide
  modified_base (16)..(16): methylated C nucleotide
  modified_base (23)..(23): methylated C nucleotide
ttggctgcgcgccatcgggccccgcccca

SEQ ID NO: 1057 - DNA, 29 bp, Artificial Sequence
  Synthetic
  modified_base (11)..(11): methylated C nucleotide
  modified_base (13)..(13): methylated C nucleotide
  modified_base (19)..(19): methylated C nucleotide
  modified_base (26)..(26): methylated C nucleotide
ccattggctgcgcgccatcgggccccgcc

SEQ ID NO: 1058 - DNA, 29 bp, Artificial Sequence
  Synthetic
  modified_base (14)..(14): methylated C nucleotide
  modified_base (16)..(16): methylated C nucleotide
  modified_base (22)..(22): methylated C nucleotide
  modified_base (29)..(29): methylated C nucleotide
ctaccattggctgcgcgccatcgggcccc

SEQ ID NO: 1059 - DNA, 29 bp, Artificial Sequence
  Synthetic
  modified_base (17)..(17): methylated C nucleotide
  modified_base (19)..(19): methylated C nucleotide
  modified_base (25)..(25): methylated C nucleotide
ggcctaccattggctgcgcgccatcgggc

SEQ ID NO: 1060 - DNA, 29 bp, Artificial Sequence
  Synthetic
  modified_base (1)..(1): methylated C nucleotide
  modified_base (7)..(7): methylated C nucleotide
  modified_base (14)..(14): methylated C nucleotide
  modified_base (24)..(24): methylated C nucleotide
cgccatcgggccccgccccaccccggttg

SEQ ID NO: 1061 - DNA, 29 bp, Artificial Sequence
  Synthetic
  modified_base (4)..(4): methylated C nucleotide
  modified_base (11)..(11): methylated C nucleotide
  modified_base (21)..(21): methylated C nucleotide
catcgggccccgccccaccccggttggct

SEQ ID NO: 1062 - DNA, 29 bp, Artificial Sequence
  Synthetic
  modified_base (1)..(1): methylated C nucleotide
  modified_base (8)..(8): methylated C nucleotide
  modified_base (18)..(18): methylated C nucleotide
cgggccccgccccaccccggttggctgag

SEQ ID NO: 1063 - DNA, 29 bp, Artificial Sequence
  Synthetic
  modified_base (5)..(5): methylated C nucleotide
  modified_base (15)..(15): methylated C nucleotide
gccccgccccaccccggttggctgagcgg

SEQ ID NO: 1064 - DNA, 29 bp, Artificial Sequence
  Synthetic
  modified_base (2)..(2): methylated C nucleotide
  modified_base (12)..(12): methylated C nucleotide
ccgccccaccccggttggctgagcggccc

SEQ ID NO: 1065 - DNA, 27 bp, Artificial Sequence
  Synthetic
  modified_base (2)..(2): methylated C nucleotide
  modified_base (8)..(8): methylated C nucleotide
  modified_base (15)..(15): methylated C nucleotide
  modified_base (25)..(25): methylated C nucleotide
gcgccatcgggccccgccccaccccgg

SEQ ID NO: 1066 - DNA, 25 bp, Artificial Sequence
  Synthetic
  modified_base (6)..(6): methylated C nucleotide
  modified_base (13)..(13): methylated C nucleotide
  modified_base (23)..(23): methylated C nucleotide
gccatcgggccccgccccaccccgg

SEQ ID NO: 1067 - DNA, 23 bp, Artificial Sequence
  Synthetic
  modified_base (4)..(4): methylated C nucleotide
  modified_base (11)..(11): methylated C nucleotide
  modified_base (21)..(21): methylated C nucleotide
catcgggccccgccccaccccgg

SEQ ID NO: 1068 - DNA, 21 bp, Artificial Sequence
  Synthetic
  modified_base (2)..(2): methylated C nucleotide
  modified_base (9)..(9): methylated C nucleotide
  modified_base (19)..(19): methylated C nucleotide
tcgggccccgccccaccccgg

SEQ ID NO: 1069 - DNA, 19 bp, Artificial Sequence
  Synthetic
  modified_base (7)..(7): methylated C nucleotide
  modified_base (17)..(17): methylated C nucleotide
gggccccgccccaccccgg

SEQ ID NO: 1070 - DNA, 17 bp, Artificial Sequence
  Synthetic
  modified_base (5)..(5): methylated C nucleotide
  modified_base (15)..(15): methylated C nucleotide
gccccgccccaccccgg

SEQ ID NO: 1071 - DNA, 15 bp, Artificial Sequence
  Synthetic
  modified_base (3)..(3): methylated C nucleotide
  modified_base (13)..(13): methylated C nucleotide
cccgccccaccccgg

SEQ ID NO: 1072 - DNA, 27 bp, Artificial Sequence
  Synthetic
  modified_base (2)..(2): methylated C nucleotide
  modified_base (4)..(4): methylated C nucleotide
  modified_base (10)..(10): methylated C nucleotide
  modified_base (17)..(17): methylated C nucleotide
  modified_base (27)..(27): methylated C nucleotide
gcgcgccatcgggccccgccccacccc

SEQ ID NO: 1073 - DNA, 25 bp, Artificial Sequence
  Synthetic
  modified_base (2)..(2): methylated C nucleotide
  modified_base (4)..(4): methylated C nucleotide
  modified_base (10)..(10): methylated C nucleotide
  modified_base (17)..(17): methylated C nucleotide
gcgcgccatcgggccccgccccacc

SEQ ID NO: 1074 - DNA, 23 bp, Artificial Sequence
  Synthetic
  modified_base (2)..(2): methylated C nucleotide
  modified_base (4)..(4): methylated C nucleotide
  modified_base (10)..(10): methylated C nucleotide
  modified_base (17)..(17): methylated C nucleotide
gcgcgccatcgggccccgcccca

SEQ ID NO: 1075 - DNA, 21 bp, Artificial Sequence
  Synthetic
  modified_base (2)..(2): methylated C nucleotide
  modified_base (4)..(4): methylated C nucleotide
  modified_base (10)..(10): methylated C nucleotide
  modified_base (17)..(17): methylated C nucleotide
gcgcgccatcgggccccgccc

SEQ ID NO: 1076 - DNA, 19 bp, Artificial Sequence
  Synthetic
  modified_base (2)..(2): methylated C nucleotide
  modified_base (4)..(4): methylated C nucleotide
  modified_base (10)..(10): methylated C nucleotide
  modified_base (17)..(17): methylated C nucleotide
gcgcgccatcgggccccgc

SEQ ID NO: 1077 - DNA, 17 bp, Artificial Sequence
  Synthetic
  modified_base (2)..(2): methylated C nucleotide
  modified_base (4)..(4): methylated C nucleotide
  modified_base (10)..(10): methylated C nucleotide
  modified_base (17)..(17): methylated C nucleotide
gcgcgccatcgggcccc

SEQ ID NO: 1078 - DNA, 15 bp, Artificial Sequence
  Synthetic
  modified_base (2)..(2): methylated C nucleotide
  modified_base (4)..(4): methylated C nucleotide
  modified_base (10)..(10): methylated C nucleotide
gcgcgccatcgggcc

SEQ ID NO: 1079 - DNA, 29 bp, Artificial Sequence
  Synthetic
  modified_base (2)..(2): methylated C nucleotide
  modified_base (4)..(4): methylated C nucleotide
  modified_base (10)..(10): methylated C nucleotide
  modified_base (17)..(17): methylated C nucleotide
  modified_base (27)..(27): methylated C nucleotide
gcgcgccatcgggcaccgccccaccccgg

SEQ ID NO: 1080 - DNA, 29 bp, Artificial Sequence
  Synthetic
  modified_base (2)..(2): methylated C nucleotide
  modified_base (4)..(4): methylated C nucleotide
  modified_base (10)..(10): methylated C nucleotide
  modified_base (17)..(17): methylated C nucleotide
  modified_base (27)..(27): methylated C nucleotide
gcgcgccatcgggccccgccctaccccgg

SEQ ID NO: 1081 - DNA, 29 bp, Artificial Sequence
  Synthetic
  modified_base (2)..(2): methylated C nucleotide
  modified_base (4)..(4): methylated C nucleotide
  modified_base (10)..(10): methylated C nucleotide
  modified_base (17)..(17): methylated C nucleotide
  modified_base (27)..(27): methylated C nucleotide
gcgcgcgatcgggccccgccccaccccgg

SEQ ID NO: 1082 - DNA, 40 bp, Artificial Sequence; identical to SEQ ID NO: 73
  Synthetic
  modified_base (13)..(13): methylated C nucleotide
  modified_base (15)..(15): methylated C nucleotide
  modified_base (17)..(17): methylated C nucleotide
  modified_base (22)..(22): methylated C nucleotide
  modified_base (27)..(27): methylated C nucleotide
  modified_base (29)..(29): methylated C nucleotide

SEQ ID NO: 1083 - DNA, 41 bp, Artificial Sequence
  Synthetic
  modified_base (14)..(14): methylated C nucleotide
  modified_base (16)..(16): methylated C nucleotide
  modified_base (18)..(18): methylated C nucleotide
  modified_base (23)..(23): methylated C nucleotide
  modified_base (28)..(28): methylated C nucleotide
  modified_base (30)..(30): methylated C nucleotide
gcgggggcgggggcgcgcggttcgccccgcgcatgggctcc

SEQ ID NO: 1084 - DNA, 42 bp, Artificial Sequence
  Synthetic
  modified_base (15)..(15): methylated C nucleotide
  modified_base (17)..(17): methylated C nucleotide
  modified_base (19)..(19): methylated C nucleotide
  modified_base (24)..(24): methylated C nucleotide
  modified_base (29)..(29): methylated C nucleotide
  modified_base (31)..(31): methylated C nucleotide
ggcgggggcgggggcgcgcggttcgccccgcgcatgggctcc

SEQ ID NO: 1085 - DNA, 43 bp, Artificial Sequence
  Synthetic
  modified_base (16)..(16): methylated C nucleotide
  modified_base (18)..(18): methylated C nucleotide
  modified_base (20)..(20): methylated C nucleotide
  modified_base (25)..(25): methylated C nucleotide
  modified_base (30)..(30): methylated C nucleotide
  modified_base (32)..(32): methylated C nucleotide
gggcgggggcgggggcgcgcggttcgccccgcgcatgggctcc

SEQ ID NO: 1086 - DNA, 44 bp, Artificial Sequence
  Synthetic
  modified_base (17)..(17): methylated C nucleotide
  modified_base (19)..(19): methylated C nucleotide
  modified_base (21)..(21): methylated C nucleotide
  modified_base (26)..(26): methylated C nucleotide
  modified_base (31)..(31): methylated C nucleotide
  modified_base (33)..(33): methylated C nucleotide
cgggcgggggcgggggcgcgcggttcgccccgcgcatgggctcc

SEQ ID NO: 1087 - DNA, 45 bp, Artificial Sequence
  Synthetic
  modified_base (18)..(18): methylated C nucleotide
  modified_base (20)..(20): methylated C nucleotide
  modified_base (22)..(22): methylated C nucleotide
  modified_base (27)..(27): methylated C nucleotide
  modified_base (32)..(32): methylated C nucleotide
  modified_base (34)..(34): methylated C nucleotide
gcgggcgggggcgggggcgcgcggttcgccccgcgcatgggctcc

SEQ ID NO: 1088 - DNA, 41 bp, Artificial Sequence
  Synthetic
  modified_base (13)..(13): methylated C nucleotide
  modified_base (15)..(15): methylated C nucleotide
  modified_base (17)..(17): methylated C nucleotide
  modified_base (22)..(22): methylated C nucleotide
  modified_base (27)..(27): methylated C nucleotide
  modified_base (29)..(29): methylated C nucleotide
cgggggcgggggcgcgcggttcgccccgcgcatgggctccg

SEQ ID NO: 1089 - DNA, 42 bp, Artificial Sequence
  Synthetic
  modified_base (13)..(13): methylated C nucleotide
  modified_base (15)..(15): methylated C nucleotide
  modified_base (17)..(17): methylated C nucleotide
  modified_base (22)..(22): methylated C nucleotide
  modified_base (27)..(27): methylated C nucleotide
  modified_base (29)..(29): methylated C nucleotide
cgggggcgggggcgcgcggttcgccccgcgcatgggctccgt

SEQ ID NO: 1090 - DNA, 43 bp, Artificial Sequence
  Synthetic
  modified_base (13)..(13): methylated C nucleotide
  modified_base (15)..(15): methylated C nucleotide
  modified_base (17)..(17): methylated C nucleotide
  modified_base (22)..(22): methylated C nucleotide
  modified_base (27)..(27): methylated C nucleotide
  modified_base (29)..(29): methylated C nucleotide
cgggggcgggggcgcgcggttcgccccgcgcatgggctccgtc

SEQ ID NO: 1091 - DNA, 44 bp, Artificial Sequence
  Synthetic
  modified_base (13)..(13): methylated C nucleotide
  modified_base (15)..(15): methylated C nucleotide
  modified_base (17)..(17): methylated C nucleotide
  modified_base (22)..(22): methylated C nucleotide
  modified_base (27)..(27): methylated C nucleotide
  modified_base (29)..(29): methylated C nucleotide
cgggggcgggggcgcgcggttcgccccgcgcatgggctccgtcc

SEQ ID NO: 1092 - DNA, 45 bp, Artificial Sequence
  Synthetic
  modified_base (13)..(13): methylated C nucleotide
  modified_base (15)..(15): methylated C nucleotide
  modified_base (17)..(17): methylated C nucleotide
  modified_base (22)..(22): methylated C nucleotide
  modified_base (27)..(27): methylated C nucleotide
  modified_base (29)..(29): methylated C nucleotide
cgggggcgggggcgcgcggttcgccccgcgcatgggctccgtccg

SEQ ID NO: 1093 - DNA, 42 bp, Artificial Sequence
  Synthetic
  modified_base (14)..(14): methylated C nucleotide
  modified_base (16)..(16): methylated C nucleotide
  modified_base (18)..(18): methylated C nucleotide
  modified_base (23)..(23): methylated C nucleotide
  modified_base (28)..(28): methylated C nucleotide
  modified_base (30)..(30): methylated C nucleotide
gcgggggcgggggcgcgcggttcgccccgcgcatgggctccg

SEQ ID NO: 1094 - DNA, 44 bp, Artificial Sequence
  Synthetic
  modified_base (15)..(15): methylated C nucleotide
  modified_base (17)..(17): methylated C nucleotide
  modified_base (19)..(19): methylated C nucleotide
  modified_base (24)..(24): methylated C nucleotide
  modified_base (29)..(29): methylated C nucleotide
  modified_base (31)..(31): methylated C nucleotide
ggcgggggcgggggcgcgcggttcgccccgcgcatgggctccgt

SEQ ID NO: 1095 - DNA, 46 bp, Artificial Sequence
  Synthetic
  modified_base (16)..(16): methylated C nucleotide
  modified_base (18)..(18): methylated C nucleotide
  modified_base (20)..(20): methylated C nucleotide
  modified_base (25)..(25): methylated C nucleotide
  modified_base (30)..(30): methylated C nucleotide
  modified_base (32)..(32): methylated C nucleotide
gggcgggggcgggggcgcgcggttcgccccgcgcatgggctccgtc

SEQ ID NO: 1096 - DNA, 48 bp, Artificial Sequence
  Synthetic
  modified_base (17)..(17): methylated C nucleotide
  modified_base (19)..(19): methylated C nucleotide
  modified_base (21)..(21): methylated C nucleotide
  modified_base (26)..(26): methylated C nucleotide
  modified_base (31)..(31): methylated C nucleotide
  modified_base (33)..(33): methylated C nucleotide
cgggcgggggcgggggcgcgcggttcgccccgcgcatgggctccgtcc

SEQ ID NO: 1097 - DNA, 50 bp, Artificial Sequence
  Synthetic
  modified_base (18)..(18): methylated C nucleotide
  modified_base (20)..(20): methylated C nucleotide
  modified_base (22)..(22): methylated C nucleotide
  modified_base (27)..(27): methylated C nucleotide
  modified_base (32)..(32): methylated C nucleotide
  modified_base (34)..(34): methylated C nucleotide
gcgggcgggggcgggggcgcgcggttcgccccgcgcatgggctccgtccg

SEQ ID NO: 1098 - DNA, 40 bp, Artificial Sequence
  Synthetic
  modified_base (16)..(16): methylated C nucleotide
  modified_base (18)..(18): methylated C nucleotide
  modified_base (20)..(20): methylated C nucleotide
  modified_base (25)..(25): methylated C nucleotide
  modified_base (30)..(30): methylated C nucleotide
  modified_base (32)..(32): methylated C nucleotide
gggcgggggcgggggcgcgcggttcgccccgcgcatgggc

SEQ ID NO: 1099 - DNA, 40 bp, Artificial Sequence
  Synthetic
  modified_base (19)..(19): methylated C nucleotide
  modified_base (21)..(21): methylated C nucleotide
  modified_base (23)..(23): methylated C nucleotide
  modified_base (28)..(28): methylated C nucleotide
  modified_base (33)..(33): methylated C nucleotide
  modified_base (35)..(35): methylated C nucleotide
ggcgggcgggggcgggggcgcgcggttcgccccgcgcatg

SEQ ID NO: 1100 - DNA, 40 bp, Artificial Sequence
  Synthetic
  modified_base (22)..(22): methylated C nucleotide
  modified_base (24)..(24): methylated C nucleotide
  modified_base (26)..(26): methylated C nucleotide
  modified_base (31)..(31): methylated C nucleotide
  modified_base (36)..(36): methylated C nucleotide
  modified_base (38)..(38): methylated C nucleotide
gggggcgggcgggggcgggggcgcgcggttcgccccgcgc

SEQ ID NO: 1101 - DNA, 40 bp, Artificial Sequence
  Synthetic
  modified_base (25)..(25): methylated C nucleotide
  modified_base (27)..(27): methylated C nucleotide
  modified_base (29)..(29): methylated C nucleotide
  modified_base (34)..(34): methylated C nucleotide
  modified_base (39)..(39): methylated C nucleotide
ggcgggggcgggcgggggcgggggcgcgcggttcgccccg

SEQ ID NO: 1102 - DNA, 40 bp, Artificial Sequence
  Synthetic
  modified_base (28)..(28): methylated C nucleotide
  modified_base (30)..(30): methylated C nucleotide
  modified_base (32)..(32): methylated C nucleotide
  modified_base (37)..(37): methylated C nucleotide
cggggcgggggcgggcgggggcgggggcgcgcggttcgcc

SEQ ID NO: 1103 - DNA, 40 bp, Artificial Sequence
  Synthetic
  modified_base (10)..(10): methylated C nucleotide
  modified_base (12)..(12): methylated C nucleotide
  modified_base (14)..(14): methylated C nucleotide
  modified_base (19)..(19): methylated C nucleotide
  modified_base (24)..(24): methylated C nucleotide
  modified_base (26)..(26): methylated C nucleotide
gggcgggggcgcgcggttcgccccgcgcatgggctccgtc

SEQ ID NO: 1104 - DNA, 40 bp, Artificial Sequence
  Synthetic
  modified_base (7)..(7): methylated C nucleotide
  modified_base (9)..(9): methylated C nucleotide
  modified_base (11)..(11): methylated C nucleotide
  modified_base (16)..(16): methylated C nucleotide
  modified_base (21)..(21): methylated C nucleotide
  modified_base (23)..(23): methylated C nucleotide
cgggggcgcgcggttcgccccgcgcatgggctccgtccgc

SEQ ID NO: 1105 - DNA, 40 bp, Artificial Sequence
  Synthetic
  modified_base (4)..(4): methylated C nucleotide
  modified_base (6)..(6): methylated C nucleotide
  modified_base (8)..(8): methylated C nucleotide
  modified_base (13)..(13): methylated C nucleotide
  modified_base (18)..(18): methylated C nucleotide
  modified_base (20)..(20): methylated C nucleotide
gggcgcgcggttcgccccgcgcatgggctccgtccgcggc

SEQ ID NO: 1106 - DNA, 40 bp, Artificial Sequence
  Synthetic
  modified_base (1)..(1): methylated C nucleotide
  modified_base (3)..(3): methylated C nucleotide
  modified_base (5)..(5): methylated C nucleotide
  modified_base (10)..(10): methylated C nucleotide
  modified_base (15)..(15): methylated C nucleotide
  modified_base (17)..(17): methylated C nucleotide
cgcgcggttcgccccgcgcatgggctccgtccgcggcggg

SEQ ID NO: 1107 - DNA, 40 bp, Artificial Sequence
  Synthetic
  modified_base (2)..(2): methylated C nucleotide
  modified_base (7)..(7): methylated C nucleotide
  modified_base (12)..(12): methylated C nucleotide
  modified_base (14)..(14): methylated C nucleotide
gcggttcgccccgcgcatgggctccgtccgcggcgggtgc

SEQ ID NO: 1108 - DNA, 38 bp, Artificial Sequence
  Synthetic
  modified_base (11)..(11): methylated C nucleotide
  modified_base (13)..(13): methylated C nucleotide
  modified_base (15)..(15): methylated C nucleotide
  modified_base (20)..(20): methylated C nucleotide
  modified_base (25)..(25): methylated C nucleotide
  modified_base (27)..(27): methylated C nucleotide
ggggcgggggcgcgcggttcgccccgcgcatgggctcc

SEQ ID NO: 1109 - DNA, 36 bp, Artificial Sequence
  Synthetic
  modified_base (9)..(9): methylated C nucleotide
  modified_base (11)..(11): methylated C nucleotide
  modified_base (13)..(13): methylated C nucleotide
  modified_base (18)..(18): methylated C nucleotide
  modified_base (23)..(23): methylated C nucleotide
  modified_base (25)..(25): methylated C nucleotide
ggcgggggcgcgcggttcgccccgcgcatgggctcc

SEQ ID NO: 1110 - DNA, 34 bp, Artificial Sequence; identical to SEQ ID NO: 881
  Synthetic
  modified_base (7)..(7): methylated C nucleotide
  modified_base (9)..(9): methylated C nucleotide
  modified_base (11)..(11): methylated C nucleotide
  modified_base (16)..(16): methylated C nucleotide
  modified_base (21)..(21): methylated C nucleotide
  modified_base (23)..(23): methylated C nucleotide

SEQ ID NO: 1111 - DNA, 32 bp, Artificial Sequence
  Synthetic
  modified_base (5)..(5): methylated C nucleotide
  modified_base (7)..(7): methylated C nucleotide
  modified_base (9)..(9): methylated C nucleotide
  modified_base (14)..(14): methylated C nucleotide
  modified_base (19)..(19): methylated C nucleotide
  modified_base (21)..(21): methylated C nucleotide
ggggcgcgcggttcgccccgcgcatgggctcc

SEQ ID NO: 1112 - DNA, 30 bp, Artificial Sequence; identical to SEQ ID NO: 876
  Synthetic
  modified_base (3)..(3): methylated C nucleotide
  modified_base (5)..(5): methylated C nucleotide
  modified_base (7)..(7): methylated C nucleotide
  modified_base (12)..(12): methylated C nucleotide
  modified_base (17)..(17): methylated C nucleotide
  modified_base (19)..(19): methylated C nucleotide

SEQ ID NO: 1113 - DNA, 28 bp, Artificial Sequence
  Synthetic
  modified_base (1)..(1): methylated C nucleotide
  modified_base (3)..(3): methylated C nucleotide
  modified_base (5)..(5): methylated C nucleotide
  modified_base (10)..(10): methylated C nucleotide
  modified_base (15)..(15): methylated C nucleotide
  modified_base (17)..(17): methylated C nucleotide
cgcgcggttcgccccgcgcatgggctcc

SEQ ID NO: 1114 - DNA, 26 bp, Artificial Sequence
  Synthetic
  modified_base (1)..(1): methylated C nucleotide
  modified_base (3)..(3): methylated C nucleotide
  modified_base (8)..(8): methylated C nucleotide
  modified_base (13)..(13): methylated C nucleotide
  modified_base (15)..(15): methylated C nucleotide
cgcggttcgccccgcgcatgggctcc

SEQ ID NO: 1115 - DNA, 24 bp, Artificial Sequence
  Synthetic
  modified_base (1)..(1): methylated C nucleotide
  modified_base (6)..(6): methylated C nucleotide
  modified_base (11)..(11): methylated C nucleotide
  modified_base (13)..(13): methylated C nucleotide
cggttcgccccgcgcatgggctcc

SEQ ID NO: 1116 - DNA, 22 bp, Artificial Sequence
  Synthetic
  modified_base (4)..(4): methylated C nucleotide
  modified_base (9)..(9): methylated C nucleotide
  modified_base (11)..(11): methylated C nucleotide
gttcgccccgcgcatgggctcc

SEQ ID NO: 1117 - DNA, 20 bp, Artificial Sequence
  Synthetic
  modified_base (2)..(2): methylated C nucleotide
  modified_base (7)..(7): methylated C nucleotide
  modified_base (9)..(9): methylated C nucleotide
tcgccccgcgcatgggctcc

SEQ ID NO: 1118 - DNA, 18 bp, Artificial Sequence
  Synthetic
  modified_base (5)..(5): methylated C nucleotide
  modified_base (7)..(7): methylated C nucleotide
gccccgcgcatgggctcc

SEQ ID NO: 1119 - DNA, 16 bp, Artificial Sequence
  Synthetic
  modified_base (3)..(3): methylated C nucleotide
  modified_base (5)..(5): methylated C nucleotide
cccgcgcatgggctcc

SEQ ID NO: 1120 - DNA, 15 bp, Artificial Sequence
  Synthetic
  modified_base (3)..(3): methylated C nucleotide
  modified_base (5)..(5): methylated C nucleotide
cccgcgcatgggctc

SEQ ID NO: 1121 - DNA, 38 bp, Artificial Sequence
  Synthetic
  modified_base (13)..(13): methylated C nucleotide
  modified_base (15)..(15): methylated C nucleotide
  modified_base (17)..(17): methylated C nucleotide
  modified_base (22)..(22): methylated C nucleotide
  modified_base (27)..(27): methylated C nucleotide
  modified_base (29)..(29): methylated C nucleotide
cgggggcgggggcgcgcggttcgccccgcgcatgggct

SEQ ID NO: 1122 - DNA, 36 bp, Artificial Sequence
  Synthetic
  modified_base (13)..(13): methylated C nucleotide
  modified_base (15)..(15): methylated C nucleotide
  modified_base (17)..(17): methylated C nucleotide
  modified_base (22)..(22): methylated C nucleotide
  modified_base (27)..(27): methylated C nucleotide
  modified_base (29)..(29): methylated C nucleotide
cgggggcgggggcgcgcggttcgccccgcgcatggg

SEQ ID NO: 1123 - DNA, 34 bp, Artificial Sequence
  Synthetic
  modified_base (13)..(13): methylated C nucleotide
  modified_base (15)..(15): methylated C nucleotide
  modified_base (17)..(17): methylated C nucleotide
  modified_base (22)..(22): methylated C nucleotide
  modified_base (27)..(27): methylated C nucleotide
  modified_base (29)..(29): methylated C nucleotide
cgggggcgggggcgcgcggttcgccccgcgcatg

SEQ ID NO: 1124 - DNA, 32 bp, Artificial Sequence
  Synthetic
  modified_base (13)..(13): methylated C nucleotide
  modified_base (15)..(15): methylated C nucleotide
  modified_base (17)..(17): methylated C nucleotide
  modified_base (22)..(22): methylated C nucleotide
  modified_base (27)..(27): methylated C nucleotide
  modified_base (29)..(29): methylated C nucleotide
cgggggcgggggcgcgcggttcgccccgcgca

SEQ ID NO: 1125 - DNA, 30 bp, Artificial Sequence
  Synthetic
  modified_base (13)..(13): methylated C nucleotide
  modified_base (15)..(15): methylated C nucleotide
  modified_base (17)..(17): methylated C nucleotide
  modified_base (22)..(22): methylated C nucleotide
  modified_base (27)..(27): methylated C nucleotide
  modified_base (29)..(29): methylated C nucleotide
cgggggcgggggcgcgcggttcgccccgcg

SEQ ID NO: 1126 - DNA, 28 bp, Artificial Sequence
  Synthetic
  modified_base (13)..(13): methylated C nucleotide
  modified_base (15)..(15): methylated C nucleotide
  modified_base (17)..(17): methylated C nucleotide
  modified_base (22)..(22): methylated C nucleotide
  modified_base (27)..(27): methylated C nucleotide
cgggggcgggggcgcgcggttcgccccg

SEQ ID NO: 1127 - DNA, 26 bp, Artificial Sequence
  Synthetic
  modified_base (13)..(13): methylated C nucleotide
  modified_base (15)..(15): methylated C nucleotide
  modified_base (17)..(17): methylated C nucleotide
  modified_base (22)..(22): methylated C nucleotide
cgggggcgggggcgcgcggttcgccc

SEQ ID NO: 1128 - DNA, 24 bp, Artificial Sequence
  Synthetic
  modified_base (13)..(13): methylated C nucleotide
  modified_base (15)..(15): methylated C nucleotide
  modified_base (17)..(17): methylated C nucleotide
  modified_base (22)..(22): methylated C nucleotide
cgggggcgggggcgcgcggttcgc

SEQ ID NO: 1129 - DNA, 22 bp, Artificial Sequence
  Synthetic
  modified_base (13)..(13): methylated C nucleotide
  modified_base (15)..(15): methylated C nucleotide
  modified_base (17)..(17): methylated C nucleotide
  modified_base (22)..(22): methylated C nucleotide
cgggggcgggggcgcgcggttc

SEQ ID NO: 1130 - DNA, 20 bp, Artificial Sequence
  Synthetic
  modified_base (13)..(13): methylated C nucleotide
  modified_base (15)..(15): methylated C nucleotide
  modified_base (17)..(17): methylated C nucleotide
cgggggcgggggcgcgcggt

SEQ ID NO: 1131 - DNA, 18 bp, Artificial Sequence
  Synthetic
  modified_base (13)..(13): methylated C nucleotide
  modified_base (15)..(15): methylated C nucleotide
  modified_base (17)..(17): methylated C nucleotide
cgggggcgggggcgcgcg

SEQ ID NO: 1132 - DNA, 16 bp, Artificial Sequence
  Synthetic
  modified_base (13)..(13): methylated C nucleotide
  modified_base (15)..(15): methylated C nucleotide
cgggggcgggggcgcg

SEQ ID NO: 1133 - DNA, 15 bp, Artificial Sequence
  Synthetic
  modified_base (13)..(13): methylated C nucleotide
  modified_base (15)..(15): methylated C nucleotide
cgggggcgggggcgc

SEQ ID NO: 1134 - DNA, 40 bp, Artificial Sequence
  Synthetic
  modified_base (13)..(13): methylated C nucleotide
  modified_base (15)..(15): methylated C nucleotide
  modified_base (17)..(17): methylated C nucleotide
  modified_base (22)..(22): methylated C nucleotide
  modified_base (27)..(27): methylated C nucleotide
  modified_base (29)..(29): methylated C nucleotide
cgggggcaggggcgcgcggttcgccccgcgcatgggctcc

SEQ ID NO: 1135 - DNA, 40 bp, Artificial Sequence
  Synthetic
  modified_base (13)..(13): methylated C nucleotide
  modified_base (15)..(15): methylated C nucleotide
  modified_base (17)..(17): methylated C nucleotide
  modified_base (22)..(22): methylated C nucleotide
  modified_base (27)..(27): methylated C nucleotide
  modified_base (29)..(29): methylated C nucleotide
cgggggcgggggcgcgcgtttcgccccgcgcatgggctcc

SEQ ID NO: 1136 - DNA, 40 bp, Artificial Sequence
  Synthetic
  modified_base (13)..(13): methylated C nucleotide
  modified_base (15)..(15): methylated C nucleotide
  modified_base (17)..(17): methylated C nucleotide
  modified_base (22)..(22): methylated C nucleotide
  modified_base (27)..(27): methylated C nucleotide
  modified_base (29)..(29): methylated C nucleotide
cgggggcgggggcgcgcggttcgccccgcacatgggctcc

SEQ ID NO: 1137 - DNA, 20 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (12)..(12): methylated C nucleotide
  modified_base (17)..(17): methylated C nucleotide
  modified_base (19)..(19): methylated C nucleotide
ggcgcgcggttcgccccgcg

SEQ ID NO: 1138 - DNA, 21 bp, Artificial Sequence
  Synthetic
  modified_base (4)..(4): methylated C nucleotide
  modified_base (6)..(6): methylated C nucleotide
  modified_base (8)..(8): methylated C nucleotide
  modified_base (13)..(13): methylated C nucleotide
  modified_base (18)..(18): methylated C nucleotide
  modified_base (20)..(20): methylated C nucleotide
gggcgcgcggttcgccccgcg

SEQ ID NO: 1139 - DNA, 22 bp, Artificial Sequence
  Synthetic
  modified_base (5)..(5): methylated C nucleotide
  modified_base (7)..(7): methylated C nucleotide
  modified_base (9)..(9): methylated C nucleotide
  modified_base (14)..(14): methylated C nucleotide
  modified_base (19)..(19): methylated C nucleotide
  modified_base (21)..(21): methylated C nucleotide
ggggcgcgcggttcgccccgcg

SEQ ID NO: 1140 - DNA, 23 bp, Artificial Sequence
  Synthetic
  modified_base (6)..(6): methylated C nucleotide
  modified_base (8)..(8): methylated C nucleotide
  modified_base (10)..(10): methylated C nucleotide
  modified_base (15)..(15): methylated C nucleotide
  modified_base (20)..(20): methylated C nucleotide
  modified_base (22)..(22): methylated C nucleotide
gggggcgcgcggttcgccccgcg

SEQ ID NO: 1141 - DNA, 24 bp, Artificial Sequence
  Synthetic
  modified_base (7)..(7): methylated C nucleotide
  modified_base (9)..(9): methylated C nucleotide
  modified_base (11)..(11): methylated C nucleotide
  modified_base (16)..(16): methylated C nucleotide
  modified_base (21)..(21): methylated C nucleotide
  modified_base (23)..(23): methylated C nucleotide
cgggggcgcgcggttcgccccgcg

SEQ ID NO: 1142 - DNA, 25 bp, Artificial Sequence
  Synthetic
  modified_base (8)..(8): methylated C nucleotide
  modified_base (10)..(10): methylated C nucleotide
  modified_base (12)..(12): methylated C nucleotide
  modified_base (17)..(17): methylated C nucleotide
  modified_base (22)..(22): methylated C nucleotide
  modified_base (24)..(24): methylated C nucleotide
gcgggggcgcgcggttcgccccgcg

SEQ ID NO: 1143 - DNA, 21 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (12)..(12): methylated C nucleotide
  modified_base (17)..(17): methylated C nucleotide
  modified_base (19)..(19): methylated C nucleotide
ggcgcgcggttcgccccgcgc

SEQ ID NO: 1144 - DNA, 22 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (12)..(12): methylated C nucleotide
  modified_base (17)..(17): methylated C nucleotide
  modified_base (19)..(19): methylated C nucleotide
ggcgcgcggttcgccccgcgca

SEQ ID NO: 1145 - DNA, 23 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (12)..(12): methylated C nucleotide
  modified_base (17)..(17): methylated C nucleotide
  modified_base (19)..(19): methylated C nucleotide
ggcgcgcggttcgccccgcgcat

SEQ ID NO: 1146 - DNA, 24 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (12)..(12): methylated C nucleotide
  modified_base (17)..(17): methylated C nucleotide
  modified_base (19)..(19): methylated C nucleotide
ggcgcgcggttcgccccgcgcatg

SEQ ID NO: 1147 - DNA, 25 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (12)..(12): methylated C nucleotide
  modified_base (17)..(17): methylated C nucleotide
  modified_base (19)..(19): methylated C nucleotide
ggcgcgcggttcgccccgcgcatgg

SEQ ID NO: 1148 - DNA, 22 bp, Artificial Sequence
  Synthetic
  modified_base (4)..(4): methylated C nucleotide
  modified_base (6)..(6): methylated C nucleotide
  modified_base (8)..(8): methylated C nucleotide
  modified_base (13)..(13): methylated C nucleotide
  modified_base (18)..(18): methylated C nucleotide
  modified_base (20)..(20): methylated C nucleotide
gggcgcgcggttcgccccgcgc

SEQ ID NO: 1149 - DNA, 24 bp, Artificial Sequence
  Synthetic
  modified_base (5)..(5): methylated C nucleotide
  modified_base (7)..(7): methylated C nucleotide
  modified_base (9)..(9): methylated C nucleotide
  modified_base (14)..(14): methylated C nucleotide
  modified_base (19)..(19): methylated C nucleotide
  modified_base (21)..(21): methylated C nucleotide
ggggcgcgcggttcgccccgcgca

SEQ ID NO: 1150 - DNA, 26 bp, Artificial Sequence
  Synthetic
  modified_base (6)..(6): methylated C nucleotide
  modified_base (8)..(8): methylated C nucleotide
  modified_base (10)..(10): methylated C nucleotide
  modified_base (15)..(15): methylated C nucleotide
  modified_base (20)..(20): methylated C nucleotide
  modified_base (22)..(22): methylated C nucleotide
gggggcgcgcggttcgccccgcgcat

SEQ ID NO: 1151 - DNA, 28 bp, Artificial Sequence
  Synthetic
  modified_base (7)..(7): methylated C nucleotide
  modified_base (9)..(9): methylated C nucleotide
  modified_base (11)..(11): methylated C nucleotide
  modified_base (16)..(16): methylated C nucleotide
  modified_base (21)..(21): methylated C nucleotide
  modified_base (23)..(23): methylated C nucleotide
cgggggcgcgcggttcgccccgcgcatg

SEQ ID NO: 1152 - DNA, 30 bp, Artificial Sequence
  Synthetic
  modified_base (8)..(8): methylated C nucleotide
  modified_base (10)..(10): methylated C nucleotide
  modified_base (12)..(12): methylated C nucleotide
  modified_base (17)..(17): methylated C nucleotide
  modified_base (22)..(22): methylated C nucleotide
  modified_base (24)..(24): methylated C nucleotide
gcgggggcgcgcggttcgccccgcgcatgg

SEQ ID NO: 1153 - DNA, 20 bp, Artificial Sequence
  Synthetic
  modified_base (6)..(6): methylated C nucleotide
  modified_base (8)..(8): methylated C nucleotide
  modified_base (10)..(10): methylated C nucleotide
  modified_base (15)..(15): methylated C nucleotide
  modified_base (20)..(20): methylated C nucleotide
gggggcgcgcggttcgcccc

SEQ ID NO: 1154 - DNA, 20 bp, Artificial Sequence
  Synthetic
  modified_base (9)..(9): methylated C nucleotide
  modified_base (11)..(11): methylated C nucleotide
  modified_base (13)..(13): methylated C nucleotide
  modified_base (18)..(18): methylated C nucleotide
ggcgggggcgcgcggttcgc

SEQ ID NO: 1155 - DNA, 20 bp, Artificial Sequence
  Synthetic
  modified_base (12)..(12): methylated C nucleotide
  modified_base (14)..(14): methylated C nucleotide
  modified_base (16)..(16): methylated C nucleotide
gggggcgggggcgcgcggtt

SEQ ID NO: 1156 - DNA, 20 bp, Artificial Sequence
  Synthetic
  modified_base (15)..(15): methylated C nucleotide
  modified_base (17)..(17): methylated C nucleotide
  modified_base (19)..(19): methylated C nucleotide
ggcgggggcgggggcgcgcg

SEQ ID NO: 1157 - DNA, 20 bp, Artificial Sequence
  Synthetic
  modified_base (18)..(18): methylated C nucleotide
  modified_base (20)..(20): methylated C nucleotide
cggggcgggggcgggggcgc

SEQ ID NO: 1158 - DNA, 20 bp, Artificial Sequence
  Synthetic
  modified_base (2)..(2): methylated C nucleotide
  modified_base (4)..(4): methylated C nucleotide
  modified_base (9)..(9): methylated C nucleotide
  modified_base (14)..(14): methylated C nucleotide
  modified_base (16)..(16): methylated C nucleotide
gcgcggttcgccccgcgcat

SEQ ID NO: 1159 - DNA, 20 bp, Artificial Sequence
  Synthetic
  modified_base (1)..(1): methylated C nucleotide
  modified_base (6)..(6): methylated C nucleotide
  modified_base (11)..(11): methylated C nucleotide
  modified_base (13)..(13): methylated C nucleotide
cggttcgccccgcgcatggg

SEQ ID NO: 1160 - DNA, 20 bp, Artificial Sequence
  Synthetic
  modified_base (3)..(3): methylated C nucleotide
  modified_base (8)..(8): methylated C nucleotide
  modified_base (10)..(10): methylated C nucleotide
ttcgccccgcgcatgggctc

SEQ ID NO: 1161 - DNA, 20 bp, Artificial Sequence
  Synthetic
  modified_base (5)..(5): methylated C nucleotide
  modified_base (7)..(7): methylated C nucleotide
gccccgcgcatgggctccgt

SEQ ID NO: 1162 - DNA, 20 bp, Artificial Sequence
  Synthetic
  modified_base (2)..(2): methylated C nucleotide
  modified_base (4)..(4): methylated C nucleotide
ccgcgcatgggctccgtccg

SEQ ID NO: 1163 - DNA, 18 bp, Artificial Sequence
  Synthetic
  modified_base (1)..(1): methylated C nucleotide
  modified_base (3)..(3): methylated C nucleotide
  modified_base (5)..(5): methylated C nucleotide
  modified_base (10)..(10): methylated C nucleotide
  modified_base (15)..(15): methylated C nucleotide
  modified_base (17)..(17): methylated C nucleotide
cgcgcggttcgccccgcg

SEQ ID NO: 1164 - DNA, 16 bp, Artificial Sequence
  Synthetic
  modified_base (1)..(1): methylated C nucleotide
  modified_base (3)..(3): methylated C nucleotide
  modified_base (8)..(8): methylated C nucleotide
  modified_base (13)..(13): methylated C nucleotide
  modified_base (15)..(15): methylated C nucleotide
cgcggttcgccccgcg

SEQ ID NO: 1165 - DNA, 15 bp, Artificial Sequence
  Synthetic
  modified_base (2)..(2): methylated C nucleotide
  modified_base (7)..(7): methylated C nucleotide
  modified_base (12)..(12): methylated C nucleotide
  modified_base (14)..(14): methylated C nucleotide
gcggttcgccccgcg

SEQ ID NO: 1166 - DNA, 18 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (12)..(12): methylated C nucleotide
  modified_base (17)..(17): methylated C nucleotide
ggcgcgcggttcgccccg

SEQ ID NO: 1167 - DNA, 16 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (12)..(12): methylated C nucleotide
ggcgcgcggttcgccc

SEQ ID NO: 1168 - DNA, 15 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (12)..(12): methylated C nucleotide
ggcgcgcggttcgcc

SEQ ID NO: 1169 - DNA, 20 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (12)..(12): methylated C nucleotide
  modified_base (17)..(17): methylated C nucleotide
  modified_base (19)..(19): methylated C nucleotide
ggcgcacggttcgccccgcg

SEQ ID NO: 1170 - DNA, 20 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (12)..(12): methylated C nucleotide
  modified_base (17)..(17): methylated C nucleotide
  modified_base (19)..(19): methylated C nucleotide
ggcgcgcggttcgtcccgcg

SEQ ID NO: 1171 - DNA, 20 bp, Artificial Sequence
  Synthetic
  modified_base (3)..(3): methylated C nucleotide
  modified_base (5)..(5): methylated C nucleotide
  modified_base (7)..(7): methylated C nucleotide
  modified_base (12)..(12): methylated C nucleotide
  modified_base (17)..(17): methylated C nucleotide
  modified_base (19)..(19): methylated C nucleotide
ggcgcgcggttcgccgcgcg

SEQ ID NO: 1172 - DNA, 26 bp, Artificial Sequence
  Synthetic
ggcgcgcggttcgccccgcgcatggg

SEQ ID NO: 1173 - DNA, 27 bp, Artificial Sequence
  Synthetic
gggcgcgcggttcgccccgcgcatggg

SEQ ID NO: 1174 - DNA, 28 bp, Artificial Sequence
  Synthetic
ggggcgcgcggttcgccccgcgcatggg

SEQ ID NO: 1175 - DNA, 29 bp, Artificial Sequence
  Synthetic
gggggcgcgcggttcgccccgcgcatggg

SEQ ID NO: 1176 - DNA, 30 bp, Artificial Sequence; identical to SEQ ID NO: 871
  Synthetic

SEQ ID NO: 1177 - DNA, 31 bp, Artificial Sequence; identical to SEQ ID NO: 872
  Synthetic

SEQ ID NO: 1178 - DNA, 27 bp, Artificial Sequence
  Synthetic
ggcgcgcggttcgccccgcgcatgggc

SEQ ID NO: 1179 - DNA, 28 bp, Artificial Sequence
  Synthetic
ggcgcgcggttcgccccgcgcatgggct

SEQ ID NO: 1180 - DNA, 29 bp, Artificial Sequence
  Synthetic
ggcgcgcggttcgccccgcgcatgggctc

SEQ ID NO: 1181 - DNA, 30 bp, Artificial Sequence; identical to SEQ ID NO: 876
  Synthetic

SEQ ID NO: 1182 - DNA, 31 bp, Artificial Sequence; identical to SEQ ID NO: 877
  Synthetic

SEQ ID NO: 1183 - DNA, 28 bp, Artificial Sequence
  Synthetic
gggcgcgcggttcgccccgcgcatgggc

SEQ ID NO: 1184 - DNA, 30 bp, Artificial Sequence; identical to SEQ ID NO: 879
  Synthetic

SEQ ID NO: 1185 - DNA, 32 bp, Artificial Sequence; identical to SEQ ID NO: 880
  Synthetic

SEQ ID NO: 1186 - DNA, 34 bp, Artificial Sequence; identical to SEQ ID NO: 881
  Synthetic

SEQ ID NO: 1187 - DNA, 36 bp, Artificial Sequence; identical to SEQ ID NO: 882
  Synthetic

SEQ ID NO: 1188 - DNA, 26 bp, Artificial Sequence
  Synthetic
gggggcgcgcggttcgccccgcgcat

SEQ ID NO: 1189 - DNA, 26 bp, Artificial Sequence
  Synthetic
ggcgggggcgcgcggttcgccccgcg

SEQ ID NO: 1190 - DNA, 26 bp, Artificial Sequence
  Synthetic
gggggcgggggcgcgcggttcgcccc

SEQ ID NO: 1191 - DNA, 26 bp, Artificial Sequence
  Synthetic
ggcgggggcgggggcgcgcggttcgc

SEQ ID NO: 1192 - DNA, 26 bp, Artificial Sequence
  Synthetic
cggggcgggggcgggggcgcgcggtt

SEQ ID NO: 1193 - DNA, 26 bp, Artificial Sequence
  Synthetic
gcgcggttcgccccgcgcatgggctc

SEQ ID NO: 1194 - DNA, 26 bp, Artificial Sequence
  Synthetic
cggttcgccccgcgcatgggctccgt

SEQ ID NO: 1195 - DNA, 26 bp, Artificial Sequence
  Synthetic
ttcgccccgcgcatgggctccgtccg

SEQ ID NO: 1196 - DNA, 26 bp, Artificial Sequence
  Synthetic
gccccgcgcatgggctccgtccgcgg

SEQ ID NO: 1197 - DNA, 26 bp, Artificial Sequence
  Synthetic
ccgcgcatgggctccgtccgcgggcc

SEQ ID NO: 1198 - DNA, 24 bp, Artificial Sequence
  Synthetic
cgcgcggttcgccccgcgcatggg

SEQ ID NO: 1199 - DNA, 22 bp, Artificial Sequence
  Synthetic
cgcggttcgccccgcgcatggg

SEQ ID NO: 1200 - DNA, 20 bp, Artificial Sequence
  Synthetic
cggttcgccccgcgcatggg

SEQ ID NO: 1201 - DNA, 18 bp, Artificial Sequence
  Synthetic
gttcgccccgcgcatggg

SEQ ID NO: 1202 - DNA, 16 bp, Artificial Sequence
  Synthetic
tcgccccgcgcatggg

SEQ ID NO: 1203 - DNA, 15 bp, Artificial Sequence
  Synthetic
cgccccgcgcatggg

SEQ ID NO: 1204 - DNA, 24 bp, Artificial Sequence
  Synthetic
ggcgcgcggttcgccccgcgcatg

SEQ ID NO: 1205 - DNA, 22 bp, Artificial Sequence
  Synthetic
ggcgcgcggttcgccccgcgca

SEQ ID NO: 1206 - DNA, 20 bp, Artificial Sequence
  Synthetic
ggcgcgcggttcgccccgcg

SEQ ID NO: 1207 - DNA, 18 bp, Artificial Sequence
  Synthetic
ggcgcgcggttcgccccg

SEQ ID NO: 1208 - DNA, 16 bp, Artificial Sequence
  Synthetic
ggcgcgcggttcgccc

SEQ ID NO: 1209 - DNA, 15 bp, Artificial Sequence
  Synthetic
ggcgcgcggttcgcc

SEQ ID NO: 1210 - DNA, 26 bp, Artificial Sequence
  Synthetic
ggcgcgctgttcgccccgcgcatggg

SEQ ID NO: 1211 - DNA, 26 bp, Artificial Sequence
  Synthetic
ggcgcgcggttcgccccgcgcctggg

SEQ ID NO: 1212 - DNA, 26 bp, Artificial Sequence
  Synthetic
ggcgcgcggttcgacccgcgcatggg

SEQ ID NO: 1213 - DNA, 31 bp, Artificial Sequence; identical to SEQ ID NO: 78
  Synthetic
  modified_base (3)..(3): methylated C nucleotide
  modified_base (7)..(7): methylated C nucleotide
  modified_base (19)..(19): methylated C nucleotide

SEQ ID NO: 1214 - DNA, 32 bp, Artificial Sequence
  Synthetic
  modified_base (4)..(4): methylated C nucleotide
  modified_base (8)..(8): methylated C nucleotide
  modified_base (20)..(20): methylated C nucleotide
cagcgtgcgggagggctgtcgcctcgccccca

SEQ ID NO: 1215 - DNA, 33 bp, Artificial Sequence
  Synthetic
  modified_base (5)..(5): methylated C nucleotide
  modified_base (7)..(7): methylated C nucleotide
  modified_base (9)..(9): methylated C nucleotide
  modified_base (21)..(21): methylated C nucleotide
ccagcgtgcgggagggctgtcgcctcgccccca

SEQ ID NO: 1216 - DNA, 34 bp, Artificial Sequence
  Synthetic
  modified_base (6)..(6): methylated C nucleotide
  modified_base (10)..(10): methylated C nucleotide
  modified_base (22)..(22): methylated C nucleotide
cccagcgtgcgggagggctgtcgcctcgccccca

SEQ ID NO: 1217 - DNA, 35 bp, Artificial Sequence
  Synthetic
  modified_base (7)..(7): methylated C nucleotide
  modified_base (11)..(11): methylated C nucleotide
  modified_base (23)..(23): methylated C nucleotide
acccagcgtgcgggagggctgtcgcctcgccccca

SEQ ID NO: 1218 - DNA, 36 bp, Artificial Sequence
  Synthetic
  modified_base (8)..(8): methylated C nucleotide
  modified_base (12)..(12): methylated C nucleotide
  modified_base (24)..(24): methylated C nucleotide
aacccagcgtgcgggagggctgtcgcctcgccccca

SEQ ID NO: 1219 - DNA, 32 bp, Artificial Sequence
  Synthetic
  modified_base (3)..(3): methylated C nucleotide
  modified_base (7)..(7): methylated C nucleotide
  modified_base (19)..(19): methylated C nucleotide
agcgtgcgggagggctgtcgcctcgcccccac

SEQ ID NO: 1220 - DNA, 33 bp, Artificial Sequence
  Synthetic
  modified_base (3)..(3): methylated C nucleotide
  modified_base (7)..(7): methylated C nucleotide
  modified_base (19)..(19): methylated C nucleotide
agcgtgcgggagggctgtcgcctcgcccccact

SEQ ID NO: 1221 - DNA, 34 bp, Artificial Sequence
  Synthetic
  modified_base (3)..(3): methylated C nucleotide
  modified_base (7)..(7): methylated C nucleotide
  modified_base (19)..(19): methylated C nucleotide
agcgtgcgggagggctgtcgcctcgcccccactt

SEQ ID NO: 1222 - DNA, 35 bp, Artificial Sequence
  Synthetic
  modified_base (3)..(3): methylated C nucleotide
  modified_base (7)..(7): methylated C nucleotide
  modified_base (19)..(19): methylated C nucleotide
agcgtgcgggagggctgtcgcctcgcccccacttg

SEQ ID NO: 1223 - DNA, 36 bp, Artificial Sequence
  Synthetic
  modified_base (3)..(3): methylated C nucleotide
  modified_base (7)..(7): methylated C nucleotide
  modified_base (19)..(19): methylated C nucleotide
agcgtgcgggagggctgtcgcctcgcccccacttgc

SEQ ID NO: 1224 - DNA, 33 bp, Artificial Sequence
  Synthetic
  modified_base (4)..(4): methylated C nucleotide
  modified_base (8)..(8): methylated C nucleotide
  modified_base (20)..(20): methylated C nucleotide
cagcgtgcgggagggctgtcgcctcgcccccac

SEQ ID NO: 1225 - DNA, 35 bp, Artificial Sequence
  Synthetic
  modified_base (5)..(5): methylated C nucleotide
  modified_base (9)..(9): methylated C nucleotide
  modified_base (21)..(21): methylated C nucleotide
ccagcgtgcgggagggctgtcgcctcgcccccact

SEQ ID NO: 1226 - DNA, 37 bp, Artificial Sequence
  Synthetic
  modified_base (6)..(6): methylated C nucleotide
  modified_base (10)..(10): methylated C nucleotide
  modified_base (22)..(22): methylated C nucleotide
cccagcgtgcgggagggctgtcgcctcgcccccactt

SEQ ID NO: 1227 - DNA, 39 bp, Artificial Sequence
  Synthetic
  modified_base (7)..(7): methylated C nucleotide
  modified_base (11)..(11): methylated C nucleotide
  modified_base (23)..(23): methylated C nucleotide
acccagcgtgcgggagggctgtcgcctcgcccccacttg

SEQ ID NO: 1228 - DNA, 41 bp, Artificial Sequence
  Synthetic
  modified_base (8)..(8): methylated C nucleotide
  modified_base (12)..(12): methylated C nucleotide
  modified_base (24)..(24): methylated C nucleotide
aacccagcgtgcgggagggctgtcgcctcgcccccacttgc

SEQ ID NO: 1229 - DNA, 31 bp, Artificial Sequence
  Synthetic
  modified_base (6)..(6): methylated C nucleotide
  modified_base (10)..(10): methylated C nucleotide
  modified_base (22)..(22): methylated C nucleotide
cccagcgtgcgggagggctgtcgcctcgccc

SEQ ID NO: 1230 - DNA, 31 bp, Artificial Sequence
  Synthetic
  modified_base (9)..(9): methylated C nucleotide
  modified_base (13)..(13): methylated C nucleotide
  modified_base (25)..(25): methylated C nucleotide
caacccagcgtgcgggagggctgtcgcctcg

SEQ ID NO: 1231 - DNA, 31 bp, Artificial Sequence
  Synthetic
  modified_base (12)..(12): methylated C nucleotide
  modified_base (16)..(16): methylated C nucleotide
  modified_base (28)..(28): methylated C nucleotide
ctgcaacccagcgtgcgggagggctgtcgcc

SEQ ID NO: 1232 - DNA, 31 bp, Artificial Sequence
  Synthetic
  modified_base (15)..(15): methylated C nucleotide
  modified_base (19)..(19): methylated C nucleotide
  modified_base (31)..(31): methylated C nucleotide
cagctgcaacccagcgtgcgggagggctgtc

SEQ ID NO: 1233 - DNA, 31 bp, Artificial Sequence
  Synthetic
  modified_base (18)..(18): methylated C nucleotide
  modified_base (22)..(22): methylated C nucleotide
gtgcagctgcaacccagcgtgcgggagggct

SEQ ID NO: 1234 - DNA, 31 bp, Artificial Sequence
  Synthetic
  modified_base (4)..(4): methylated C nucleotide
  modified_base (16)..(16): methylated C nucleotide
gtgcgggagggctgtcgcctcgcccccactt

SEQ ID NO: 1235 - DNA, 31 bp, Artificial Sequence
  Synthetic
  modified_base (1)..(1): methylated C nucleotide
  modified_base (13)..(13): methylated C nucleotide
cgggagggctgtcgcctcgcccccacttgct

SEQ ID NO: 1236 - DNA, 31 bp, Artificial Sequence
  Synthetic
  modified_base (10)..(10): methylated C nucleotide
gagggctgtcgcctcgcccccacttgctctt

SEQ ID NO: 1237 - DNA, 31 bp, Artificial Sequence
  Synthetic
  modified_base (7)..(7): methylated C nucleotide
ggctgtcgcctcgcccccacttgctcttaat

SEQ ID NO: 1238 - DNA, 31 bp, Artificial Sequence
  Synthetic
  modified_base (4)..(4): methylated C nucleotide
tgtcgcctcgcccccacttgctcttaatgac

SEQ ID NO: 1239 - DNA, 29 bp, Artificial Sequence
  Synthetic
  modified_base (1)..(1): methylated C nucleotide
  modified_base (5)..(5): methylated C nucleotide
  modified_base (17)..(17): methylated C nucleotide
cgtgcgggagggctgtcgcctcgccccca

SEQ ID NO: 1240 - DNA, 27 bp, Artificial Sequence
  Synthetic
  modified_base (3)..(3): methylated C nucleotide
  modified_base (15)..(15): methylated C nucleotide
tgcgggagggctgtcgcctcgccccca

SEQ ID NO: 1241 - DNA, 25 bp, Artificial Sequence
  Synthetic
  modified_base (1)..(1): methylated C nucleotide
  modified_base (13)..(13): methylated C nucleotide
cgggagggctgtcgcctcgccccca

SEQ ID NO: 1242 - DNA, 23 bp, Artificial Sequence
  Synthetic
  modified_base (11)..(11): methylated C nucleotide
ggagggctgtcgcctcgccccca

SEQ ID NO: 1243 - DNA, 21 bp, Artificial Sequence
  Synthetic
  modified_base (9)..(9): methylated C nucleotide
agggctgtcgcctcgccccca

SEQ ID NO: 1244 - DNA, 19 bp, Artificial Sequence
  Synthetic
  modified_base (7)..(7): methylated C nucleotide
ggctgtcgcctcgccccca

SEQ ID NO: 1245 - DNA, 17 bp, Artificial Sequence
  Synthetic
  modified_base (5)..(5): methylated C nucleotide
ctgtcgcctcgccccca

SEQ ID NO: 1246 - DNA, 15 bp, Artificial Sequence
  Synthetic
  modified_base (3)..(3): methylated C nucleotide
gtcgcctcgccccca

SEQ ID NO: 1247 - DNA, 29 bp, Artificial Sequence
  Synthetic
  modified_base (3)..(3): methylated C nucleotide
  modified_base (7)..(7): methylated C nucleotide
  modified_base (19)..(19): methylated C nucleotide
agcgtgcgggagggctgtcgcctcgcccc

SEQ ID NO: 1248 - DNA, 27 bp, Artificial Sequence
  Synthetic
  modified_base (3)..(3): methylated C nucleotide
  modified_base (7)..(7): methylated C nucleotide
  modified_base (19)..(19): methylated C nucleotide
agcgtgcgggagggctgtcgcctcgcc

SEQ ID NO: 1249 - DNA, 25 bp, Artificial Sequence
  Synthetic
  modified_base (3)..(3): methylated C nucleotide
  modified_base (7)..(7): methylated C nucleotide
  modified_base (19)..(19): methylated C nucleotide
agcgtgcgggagggctgtcgcctcg

SEQ ID NO: 1250 - DNA, 23 bp, Artificial Sequence
  Synthetic
  modified_base (3)..(3): methylated C nucleotide
  modified_base (7)..(7): methylated C nucleotide
  modified_base (19)..(19): methylated C nucleotide
agcgtgcgggagggctgtcgcct

SEQ ID NO: 1251 - DNA, 21 bp, Artificial Sequence
  Synthetic
  modified_base (3)..(3): methylated C nucleotide
  modified_base (7)..(7): methylated C nucleotide
  modified_base (19)..(19): methylated C nucleotide
agcgtgcgggagggctgtcgc

SEQ ID NO: 1252 - DNA, 19 bp, Artificial Sequence
  Synthetic
  modified_base (3)..(3): methylated C nucleotide
  modified_base (7)..(7): methylated C nucleotide
  modified_base (19)..(19): methylated C nucleotide
agcgtgcgggagggctgtc

SEQ ID NO: 1253 - DNA, 17 bp, Artificial Sequence
  Synthetic
  modified_base (3)..(3): methylated C nucleotide
  modified_base (7)..(7): methylated C nucleotide
agcgtgcgggagggctg

SEQ ID NO: 1254 - DNA, 15 bp, Artificial Sequence
  Synthetic
  modified_base (3)..(3): methylated C nucleotide
  modified_base (7)..(7): methylated C nucleotide
agcgtgcgggagggc

SEQ ID NO: 1255 - DNA, 31 bp, Artificial Sequence
  Synthetic
  modified_base (3)..(3): methylated C nucleotide
  modified_base (7)..(7): methylated C nucleotide
  modified_base (19)..(19): methylated C nucleotide
agcgagcgggagggctgtcgcctcgccccca

SEQ ID NO: 1256 - DNA, 31 bp, Artificial Sequence
  Synthetic
  modified_base (3)..(3): methylated C nucleotide
  modified_base (7)..(7): methylated C nucleotide
  modified_base (19)..(19): methylated C nucleotide
agcgtgcgggagggatgtcgcctcgccccca

SEQ ID NO: 1257 - DNA, 31 bp, Artificial Sequence
  Synthetic
  modified_base (3)..(3): methylated C nucleotide
  modified_base (7)..(7): methylated C nucleotide
  modified_base (19)..(19): methylated C nucleotide
agcgtgcgggagggctgtcgcgtcgccccca

SEQ ID NO: 1258 - DNA, 26 bp, Artificial Sequence
  Synthetic
  modified_base (2)..(2): methylated C nucleotide
  modified_base (7)..(7): methylated C nucleotide
  modified_base (14)..(14): methylated C nucleotide
  modified_base (18)..(18): methylated C nucleotide
gcggctcgggttgcgggcgcagggca

SEQ ID NO: 1259 - DNA, 27 bp, Artificial Sequence
  Synthetic
  modified_base (3)..(3): methylated C nucleotide
  modified_base (8)..(8): methylated C nucleotide
  modified_base (15)..(15): methylated C nucleotide
  modified_base (19)..(19): methylated C nucleotide
tgcggctcgggttgcgggcgcagggca

SEQ ID NO: 1260 - DNA, 28 bp, Artificial Sequence
  Synthetic
  modified_base (4)..(4): methylated C nucleotide
  modified_base (9)..(9): methylated C nucleotide
  modified_base (16)..(16): methylated C nucleotide
  modified_base (20)..(20): methylated C nucleotide
gtgcggctcgggttgcgggcgcagggca

SEQ ID NO: 1261 - DNA, 29 bp, Artificial Sequence
  Synthetic
  modified_base (5)..(5): methylated C nucleotide
  modified_base (10)..(10): methylated C nucleotide
  modified_base (17)..(17): methylated C nucleotide
  modified_base (21)..(21): methylated C nucleotide
ggtgcggctcgggttgcgggcgcagggca

SEQ ID NO: 1262 - DNA, 30 bp, Artificial Sequence
  Synthetic
  modified_base (6)..(6): methylated C nucleotide
  modified_base (11)..(11): methylated C nucleotide
  modified_base (18)..(18): methylated C nucleotide
  modified_base (22)..(22): methylated C nucleotide
gggtgcggctcgggttgcgggcgcagggca

SEQ ID NO: 1263 - DNA, 31 bp, Artificial Sequence
  Synthetic
  modified_base (7)..(7): methylated C nucleotide
  modified_base (12)..(12): methylated C nucleotide
  modified_base (19)..(19): methylated C nucleotide
  modified_base (23)..(23): methylated C nucleotide
cgggtgcggctcgggttgcgggcgcagggca

SEQ ID NO: 1264 - DNA, 27 bp, Artificial Sequence
  Synthetic
  modified_base (2)..(2): methylated C nucleotide
  modified_base (7)..(7): methylated C nucleotide
  modified_base (14)..(14): methylated C nucleotide
  modified_base (18)..(18): methylated C nucleotide
gcggctcgggttgcgggcgcagggcac

SEQ ID NO: 1265 - DNA, 28 bp, Artificial Sequence
  Synthetic
  modified_base (2)..(2): methylated C nucleotide
  modified_base (7)..(7): methylated C nucleotide
  modified_base (14)..(14): methylated C nucleotide
  modified_base (18)..(18): methylated C nucleotide
gcggctcgggttgcgggcgcagggcacg

SEQ ID NO: 1266 - DNA, 29 bp, Artificial Sequence
  Synthetic
  modified_base (2)..(2): methylated C nucleotide
  modified_base (7)..(7): methylated C nucleotide
  modified_base (14)..(14): methylated C nucleotide
  modified_base (18)..(18): methylated C nucleotide
gcggctcgggttgcgggcgcagggcacgg

SEQ ID NO: 1267 - DNA, 30 bp, Artificial Sequence
  Synthetic
  modified_base (2)..(2): methylated C nucleotide
  modified_base (7)..(7): methylated C nucleotide
  modified_base (14)..(14): methylated C nucleotide
  modified_base (18)..(18): methylated C nucleotide
gcggctcgggttgcgggcgcagggcacggg

SEQ ID NO: 1268 - DNA, 31 bp, Artificial Sequence
  Synthetic
  modified_base (2)..(2): methylated C nucleotide
  modified_base (7)..(7): methylated C nucleotide
  modified_base (14)..(14): methylated C nucleotide
  modified_base (18)..(18): methylated C nucleotide
gcggctcgggttgcgggcgcagggcacgggc

SEQ ID NO: 1269 - DNA, 28 bp, Artificial Sequence
  Synthetic
  modified_base (3)..(3): methylated C nucleotide
  modified_base (8)..(8): methylated C nucleotide
  modified_base (15)..(15): methylated C nucleotide
  modified_base (19)..(19): methylated C nucleotide
tgcggctcgggttgcgggcgcagggcac

SEQ ID NO: 1270 - DNA, 30 bp, Artificial Sequence
  Synthetic
  modified_base (4)..(4): methylated C nucleotide
  modified_base (9)..(9): methylated C nucleotide
  modified_base (16)..(16): methylated C nucleotide
  modified_base (20)..(20): methylated C nucleotide
gtgcggctcgggttgcgggcgcagggcacg

SEQ ID NO: 1271 - DNA, 32 bp, Artificial Sequence
  Synthetic
  modified_base (5)..(5): methylated C nucleotide
  modified_base (10)..(10): methylated C nucleotide
  modified_base (17)..(17): methylated C nucleotide
ggtgcggctcgggttgcgggcgcagggcacgg

SEQ ID NO: 1272 - DNA, 34 bp, Artificial Sequence
  Synthetic
  modified_base (6)..(6): methylated C nucleotide
  modified_base (11)..(11): methylated C nucleotide
  modified_base (18)..(18): methylated C nucleotide
  modified_base (22)..(22): methylated C nucleotide
gggtgcggctcgggttgcgggcgcagggcacggg

SEQ ID NO: 1273 - DNA, 36 bp, Artificial Sequence
  Synthetic
  modified_base (7)..(7): methylated C nucleotide
  modified_base (12)..(12): methylated C nucleotide
  modified_base (19)..(19): methylated C nucleotide
  modified_base (23)..(23): methylated C nucleotide
cgggtgcggctcgggttgcgggcgcagggcacgggc

SEQ ID NO: 1274 - DNA, 26 bp, Artificial Sequence
  Synthetic
  modified_base (5)..(5): methylated C nucleotide
  modified_base (10)..(10): methylated C nucleotide
  modified_base (17)..(17): methylated C nucleotide
  modified_base (21)..(21): methylated C nucleotide
ggtgcggctcgggttgcgggcgcagg

SEQ ID NO: 1275 - DNA, 26 bp, Artificial Sequence
  Synthetic
  modified_base (8)..(8): methylated C nucleotide
  modified_base (13)..(13): methylated C nucleotide
  modified_base (20)..(20): methylated C nucleotide
  modified_base (24)..(24): methylated C nucleotide
gcgggtgcggctcgggttgcgggcgc

SEQ ID NO: 1276 - DNA, 26 bp, Artificial Sequence
  Synthetic
  modified_base (11)..(11): methylated C nucleotide
  modified_base (16)..(16): methylated C nucleotide
  modified_base (23)..(23): methylated C nucleotide
gcggcgggtgcggctcgggttgcggg

SEQ ID NO: 1277 - DNA, 26 bp, Artificial Sequence
  Synthetic
  modified_base (14)..(14): methylated C nucleotide
  modified_base (19)..(19): methylated C nucleotide
  modified_base (26)..(26): methylated C nucleotide
tccgcggcgggtgcggctcgggttgc

SEQ ID NO: 1278 - DNA, 26 bp, Artificial Sequence
  Synthetic
  modified_base (17)..(17): methylated C nucleotide
  modified_base (22)..(22): methylated C nucleotide
ccgtccgcggcgggtgcggctcgggt

SEQ ID NO: 1279 - DNA, 26 bp, Artificial Sequence
  Synthetic
  modified_base (4)..(4): methylated C nucleotide
  modified_base (11)..(11): methylated C nucleotide
  modified_base (15)..(15): methylated C nucleotide
gctcgggttgcgggcgcagggcacgg

SEQ ID NO: 1280 - DNA, 26 bp, Artificial Sequence
  Synthetic
  modified_base (1)..(1): methylated C nucleotide
  modified_base (8)..(8): methylated C nucleotide
  modified_base (12)..(12): methylated C nucleotide
cgggttgcgggcgcagggcacgggcg

SEQ ID NO: 1281 - DNA, 26 bp, Artificial Sequence
  Synthetic
  modified_base (5)..(5): methylated C nucleotide
  modified_base (9)..(9): methylated C nucleotide
gttgcgggcgcagggcacgggcggcg

SEQ ID NO: 1282 - DNA, 26 bp, Artificial Sequence
  Synthetic
  modified_base (2)..(2): methylated C nucleotide
  modified_base (6)..(6): methylated C nucleotide
gcgggcgcagggcacgggcggcggag

SEQ ID NO: 1283 - DNA, 26 bp, Artificial Sequence
  Synthetic
  modified_base (3)..(3): methylated C nucleotide
ggcgcagggcacgggcggcggagact

SEQ ID NO: 1284 - DNA, 24 bp, Artificial Sequence
  Synthetic
  modified_base (5)..(5): methylated C nucleotide
  modified_base (12)..(12): methylated C nucleotide
  modified_base (16)..(16): methylated C nucleotide
ggctcgggttgcgggcgcagggca

SEQ ID NO: 1285 - DNA, 22 bp, Artificial Sequence
  Synthetic
  modified_base (3)..(3): methylated C nucleotide
  modified_base (10)..(10): methylated C nucleotide
  modified_base (14)..(14): methylated C nucleotide
ctcgggttgcgggcgcagggca

SEQ ID NO: 1286 - DNA, 20 bp, Artificial Sequence
  Synthetic
  modified_base (1)..(1): methylated C nucleotide
  modified_base (8)..(8): methylated C nucleotide
  modified_base (12)..(12): methylated C nucleotide
cgggttgcgggcgcagggca

SEQ ID NO: 1287 - DNA, 18 bp, Artificial Sequence
  Synthetic
  modified_base (6)..(6): methylated C nucleotide
  modified_base (10)..(10): methylated C nucleotide
ggttgcgggcgcagggca

SEQ ID NO: 1288 - DNA, 16 bp, Artificial Sequence
  Synthetic
  modified_base (4)..(4): methylated C nucleotide
  modified_base (8)..(8): methylated C nucleotide
ttgcgggcgcagggca

SEQ ID NO: 1289 - DNA, 15 bp, Artificial Sequence
  Synthetic
  modified_base (3)..(3): methylated C nucleotide
  modified_base (7)..(7): methylated C nucleotide
tgcgggcgcagggca

SEQ ID NO: 1290 - DNA, 24 bp, Artificial Sequence
  Synthetic
  modified_base (2)..(2): methylated C nucleotide
  modified_base (7)..(7): methylated C nucleotide
  modified_base (14)..(14): methylated C nucleotide
  modified_base (18)..(18): methylated C nucleotide
gcggctcgggttgcgggcgcaggg

SEQ ID NO: 1291 - DNA, 22 bp, Artificial Sequence
  Synthetic
  modified_base (2)..(2): methylated C nucleotide
  modified_base (7)..(7): methylated C nucleotide
  modified_base (14)..(14): methylated C nucleotide
  modified_base (18)..(18): methylated C nucleotide
gcggctcgggttgcgggcgcag

SEQ ID NO: 1292 - DNA, 20 bp, Artificial Sequence
  Synthetic
  modified_base (2)..(2): methylated C nucleotide
  modified_base (7)..(7): methylated C nucleotide
  modified_base (14)..(14): methylated C nucleotide
  modified_base (18)..(18): methylated C nucleotide
gcggctcgggttgcgggcgc

SEQ ID NO: 1293 - DNA, 18 bp, Artificial Sequence
  Synthetic
  modified_base (2)..(2): methylated C nucleotide
  modified_base (7)..(7): methylated C nucleotide
  modified_base (14)..(14): methylated C nucleotide
  modified_base (18)..(18): methylated C nucleotide
gcggctcgggttgcgggc

SEQ ID NO: 1294 - DNA, 16 bp, Artificial Sequence
  Synthetic
  modified_base (2)..(2): methylated C nucleotide
  modified_base (7)..(7): methylated C nucleotide
  modified_base (14)..(14): methylated C nucleotide
gcggctcgggttgcgg

SEQ ID NO: 1295 - DNA, 15 bp, Artificial Sequence
  Synthetic
  modified_base (2)..(2): methylated C nucleotide
  modified_base (7)..(7): methylated C nucleotide
  modified_base (14)..(14): methylated C nucleotide
gcggctcgggttgcg

SEQ ID NO: 1296 - DNA, 26 bp, Artificial Sequence
  Synthetic
  modified_base (2)..(2): methylated C nucleotide
  modified_base (7)..(7): methylated C nucleotide
  modified_base (14)..(14): methylated C nucleotide
  modified_base (18)..(18): methylated C nucleotide
gcgactcgggttgcgggcgcagggca

SEQ ID NO: 1297 - DNA, 26 bp, Artificial Sequence
  Synthetic
  modified_base (2)..(2): methylated C nucleotide
  modified_base (7)..(7): methylated C nucleotide
  modified_base (14)..(14): methylated C nucleotide
  modified_base (18)..(18): methylated C nucleotide
gcggctcgggttgcggtcgcagggca

SEQ ID NO: 1298 - DNA, 26 bp, Artificial Sequence
  Synthetic
  modified_base (2)..(2): methylated C nucleotide
  modified_base (7)..(7): methylated C nucleotide
  modified_base (14)..(14): methylated C nucleotide
  modified_base (18)..(18): methylated C nucleotide
gcggctcgggttccgggcgcagggca

SEQ ID NO: 1299 - DNA, 26 bp, Artificial Sequence
  Synthetic
  modified_base (6)..(6): methylated C nucleotide
  modified_base (12)..(12): methylated C nucleotide
  modified_base (19)..(19): methylated C nucleotide
  modified_base (24)..(24): methylated C nucleotide
aggggcggggacgctgagcgcaccga

SEQ ID NO: 1300 - DNA, 27 bp, Artificial Sequence
  Synthetic
  modified_base (7)..(7): methylated C nucleotide
  modified_base (13)..(13): methylated C nucleotide
  modified_base (20)..(20): methylated C nucleotide
  modified_base (25)..(25): methylated C nucleotide
aaggggcggggacgctgagcgcaccga

SEQ ID NO: 1301 - DNA, 28 bp, Artificial Sequence
  Synthetic
  modified_base (8)..(8): methylated C nucleotide
  modified_base (14)..(14): methylated C nucleotide
  modified_base (21)..(21): methylated C nucleotide
  modified_base (26)..(26): methylated C nucleotide
taaggggcggggacgctgagcgcaccga

SEQ ID NO: 1302 - DNA, 29 bp, Artificial Sequence
  Synthetic
  modified_base (9)..(9): methylated C nucleotide
  modified_base (15)..(15): methylated C nucleotide
  modified_base (22)..(22): methylated C nucleotide
  modified_base (27)..(27): methylated C nucleotide
gtaaggggcggggacgctgagcgcaccga

SEQ ID NO: 1303 - DNA, 30 bp, Artificial Sequence
  Synthetic
  modified_base (10)..(10): methylated C nucleotide
  modified_base (16)..(16): methylated C nucleotide
  modified_base (23)..(23): methylated C nucleotide
  modified_base (28)..(28): methylated C nucleotide
ggtaaggggcggggacgctgagcgcaccga

SEQ ID NO: 1304 - DNA, 31 bp, Artificial Sequence
  Synthetic
  modified_base (11)..(11): methylated C nucleotide
  modified_base (17)..(17): methylated C nucleotide
  modified_base (24)..(24): methylated C nucleotide
  modified_base (29)..(29): methylated C nucleotide
gggtaaggggcggggacgctgagcgcaccga

SEQ ID NO: 1305 - DNA, 27 bp, Artificial Sequence
  Synthetic
  modified_base (6)..(6): methylated C nucleotide
  modified_base (12)..(12): methylated C nucleotide
  modified_base (19)..(19): methylated C nucleotide
  modified_base (24)..(24): methylated C nucleotide
aggggcggggacgctgagcgcaccgag

SEQ ID NO: 1306 - DNA, 28 bp, Artificial Sequence
  Synthetic
  modified_base (6)..(6): methylated C nucleotide
  modified_base (12)..(12): methylated C nucleotide
  modified_base (19)..(19): methylated C nucleotide
  modified_base (24)..(24): methylated C nucleotide
aggggcggggacgctgagcgcaccgagc

SEQ ID NO: 1307 - DNA, 29 bp, Artificial Sequence
  Synthetic
  modified_base (6)..(6): methylated C nucleotide
  modified_base (12)..(12): methylated C nucleotide
  modified_base (19)..(19): methylated C nucleotide
  modified_base (24)..(24): methylated C nucleotide
aggggcggggacgctgagcgcaccgagca

SEQ ID NO: 1308 - DNA, 30 bp, Artificial Sequence
  Synthetic
  modified_base (6)..(6): methylated C nucleotide
  modified_base (12)..(12): methylated C nucleotide
  modified_base (19)..(19): methylated C nucleotide
  modified_base (24)..(24): methylated C nucleotide
aggggcggggacgctgagcgcaccgagcag

SEQ ID NO: 1309 - DNA, 31 bp, Artificial Sequence
  Synthetic
  modified_base (6)..(6): methylated C nucleotide
  modified_base (12)..(12): methylated C nucleotide
  modified_base (19)..(19): methylated C nucleotide
  modified_base (24)..(24): methylated C nucleotide
aggggcggggacgctgagcgcaccgagcagg

SEQ ID NO: 1310 - DNA, 28 bp, Artificial Sequence
  Synthetic
  modified_base (7)..(7): methylated C nucleotide
  modified_base (13)..(13): methylated C nucleotide
  modified_base (20)..(20): methylated C nucleotide
  modified_base (25)..(25): methylated C nucleotide
aaggggcggggacgctgagcgcaccgag

SEQ ID NO: 1311 - DNA, 30 bp, Artificial Sequence
  Synthetic
  modified_base (8)..(8): methylated C nucleotide
  modified_base (14)..(14): methylated C nucleotide
  modified_base (21)..(21): methylated C nucleotide
  modified_base (26)..(26): methylated C nucleotide
taaggggcggggacgctgagcgcaccgagc

SEQ ID NO: 1312 - DNA, 32 bp, Artificial Sequence
  Synthetic
  modified_base (9)..(9): methylated C nucleotide
  modified_base (15)..(15): methylated C nucleotide
  modified_base (22)..(22): methylated C nucleotide
  modified_base (27)..(27): methylated C nucleotide
gtaaggggcggggacgctgagcgcaccgagca

SEQ ID NO: 1313 - DNA, 34 bp, Artificial Sequence
  Synthetic
  modified_base (10)..(10): methylated C nucleotide
  modified_base (16)..(16): methylated C nucleotide
  modified_base (23)..(23): methylated C nucleotide
  modified_base (28)..(28): methylated C nucleotide
ggtaaggggcggggacgctgagcgcaccgagcag

SEQ ID NO: 1314 - DNA, 36 bp, Artificial Sequence
  Synthetic
  modified_base (11)..(11): methylated C nucleotide
  modified_base (17)..(17): methylated C nucleotide
  modified_base (24)..(24): methylated C nucleotide
  modified_base (29)..(29): methylated C nucleotide
gggtaaggggcggggacgctgagcgcaccgagcagg

SEQ ID NO: 1315 - DNA, 26 bp, Artificial Sequence
  Synthetic
  modified_base (9)..(9): methylated C nucleotide
  modified_base (15)..(15): methylated C nucleotide
  modified_base (22)..(22): methylated C nucleotide
gtaaggggcggggacgctgagcgcac

SEQ ID NO: 1316 - DNA, 26 bp, Artificial Sequence
  Synthetic
  modified_base (12)..(12): methylated C nucleotide
  modified_base (18)..(18): methylated C nucleotide
ggggtaaggggcggggacgctgagcg

SEQ ID NO: 1317 - DNA, 27 bp, Artificial Sequence
  Synthetic
  modified_base (15)..(15): methylated C nucleotide
  modified_base (21)..(21): methylated C nucleotide
tttggggtaaggggcggggacgctgag

SEQ ID NO: 1318 - DNA, 27 bp, Artificial Sequence
  Synthetic
  modified_base (18)..(18): methylated C nucleotide
  modified_base (24)..(24): methylated C nucleotide
gggtttggggtaaggggcggggacgct

SEQ ID NO: 1319 - DNA, 27 bp, Artificial Sequence
  Synthetic
  modified_base (21)..(21): methylated C nucleotide
  modified_base (27)..(27): methylated C nucleotide
tgggggtttggggtaaggggcggggac

SEQ ID NO: 1320 - DNA, 26 bp, Artificial Sequence
  Synthetic
  modified_base (3)..(3): methylated C nucleotide
  modified_base (9)..(9): methylated C nucleotide
  modified_base (16)..(16): methylated C nucleotide
  modified_base (21)..(21): methylated C nucleotide
ggcggggacgctgagcgcaccgagca

SEQ ID NO: 1321 - DNA, 26 bp, Artificial Sequence
  Synthetic
  modified_base (6)..(6): methylated C nucleotide
  modified_base (13)..(13): methylated C nucleotide
  modified_base (18)..(18): methylated C nucleotide
ggggacgctgagcgcaccgagcaggg

SEQ ID NO: 1322 - DNA, 26 bp, Artificial Sequence
  Synthetic
  modified_base (3)..(3): methylated C nucleotide
  modified_base (10)..(10): methylated C nucleotide
  modified_base (15)..(15): methylated C nucleotide
gacgctgagcgcaccgagcagggcgc

SEQ ID NO: 1323 - DNA, 26 bp, Artificial Sequence
  Synthetic
  modified_base (7)..(7): methylated C nucleotide
  modified_base (12)..(12): methylated C nucleotide
gctgagcgcaccgagcagggcgcggg

SEQ ID NO: 1324 - DNA, 26 bp, Artificial Sequence
  Synthetic
  modified_base (4)..(4): methylated C nucleotide
  modified_base (9)..(9): methylated C nucleotide
gagcgcaccgagcagggcgcgggctg

SEQ ID NO: 1325 - DNA, 24 bp, Artificial Sequence
  Synthetic
  modified_base (4)..(4): methylated C nucleotide
  modified_base (10)..(10): methylated C nucleotide
  modified_base (17)..(17): methylated C nucleotide
  modified_base (22)..(22): methylated C nucleotide
gggcggggacgctgagcgcaccga

SEQ ID NO: 1326 - DNA, 22 bp, Artificial Sequence
  Synthetic
  modified_base (2)..(2): methylated C nucleotide
  modified_base (8)..(8): methylated C nucleotide
  modified_base (15)..(15): methylated C nucleotide
  modified_base (20)..(20): methylated C nucleotide
gcggggacgctgagcgcaccga

SEQ ID NO: 1327 - DNA, 20 bp, Artificial Sequence
  Synthetic
  modified_base (6)..(6): methylated C nucleotide
  modified_base (13)..(13): methylated C nucleotide
  modified_base (18)..(18): methylated C nucleotide
ggggacgctgagcgcaccga

SEQ ID NO: 1328 - DNA, 18 bp, Artificial Sequence
  Synthetic
  modified_base (4)..(4): methylated C nucleotide
  modified_base (11)..(11): methylated C nucleotide
  modified_base (16)..(16): methylated C nucleotide
ggacgctgagcgcaccga

SEQ ID NO: 1329 - DNA, 16 bp, Artificial Sequence
  Synthetic
  modified_base (2)..(2): methylated C nucleotide
  modified_base (9)..(9): methylated C nucleotide
  modified_base (14)..(14): methylated C nucleotide
acgctgagcgcaccga

SEQ ID NO: 1330 - DNA, 14 bp, Artificial Sequence
  Synthetic
  modified_base (7)..(7): methylated C nucleotide
  modified_base (12)..(12): methylated C nucleotide
gctgagcgcaccga

SEQ ID NO: 1331 - DNA, 24 bp, Artificial Sequence
  Synthetic
  modified_base (6)..(6): methylated C nucleotide
  modified_base (12)..(12): methylated C nucleotide
  modified_base (19)..(19): methylated C nucleotide
  modified_base (24)..(24): methylated C nucleotide
aggggcggggacgctgagcgcacc

SEQ ID NO: 1332 - DNA, 22 bp, Artificial Sequence
  Synthetic
  modified_base (6)..(6): methylated C nucleotide
  modified_base (12)..(12): methylated C nucleotide
  modified_base (19)..(19): methylated C nucleotide
aggggcggggacgctgagcgca

SEQ ID NO: 1333 - DNA, 20 bp, Artificial Sequence
  Synthetic
  modified_base (6)..(6): methylated C nucleotide
  modified_base (12)..(12): methylated C nucleotide
  modified_base (19)..(19): methylated C nucleotide
aggggcggggacgctgagcg

SEQ ID NO: 1334 - DNA, 19 bp, Artificial Sequence
  Synthetic
  modified_base (6)..(6): methylated C nucleotide
  modified_base (12)..(12): methylated C nucleotide
  modified_base (19)..(19): methylated C nucleotide
aggggcggggacgctgagc

SEQ ID NO: 1335 - DNA, 17 bp, Artificial Sequence
  Synthetic
  modified_base (6)..(6): methylated C nucleotide
  modified_base (12)..(12): methylated C nucleotide
aggggcggggacgctga

SEQ ID NO: 1336 - DNA, 15 bp, Artificial Sequence
  Synthetic
  modified_base (6)..(6): methylated C nucleotide
  modified_base (12)..(12): methylated C nucleotide
aggggcggggacgct

SEQ ID NO: 1337 - DNA, 26 bp, Artificial Sequence
  Synthetic
  modified_base (6)..(6): methylated C nucleotide
  modified_base (12)..(12): methylated C nucleotide
  modified_base (19)..(19): methylated C nucleotide
  modified_base (24)..(24): methylated C nucleotide
aggggcgaggacgctgagcgcaccga

SEQ ID NO: 1338 - DNA, 26 bp, Artificial Sequence
  Synthetic
  modified_base (6)..(6): methylated C nucleotide
  modified_base (12)..(12): methylated C nucleotide
  modified_base (19)..(19): methylated C nucleotide
  modified_base (24)..(24): methylated C nucleotide
aggggcggggacgctgatcgcaccga

SEQ ID NO: 1339 - DNA, 26 bp, Artificial Sequence
  Synthetic
  modified_base (6)..(6): methylated C nucleotide
  modified_base (12)..(12): methylated C nucleotide
  modified_base (19)..(19): methylated C nucleotide
  modified_base (24)..(24): methylated C nucleotide
aggggcggggacgctcagcgcaccga

SEQ ID NO: 1340 - DNA, 35 bp, Artificial Sequence; identical to SEQ ID NO: 136
  Synthetic
  modified_base (7)..(7): methylated C nucleotide
  modified_base (10)..(10): methylated C nucleotide
  modified_base (12)..(12): methylated C nucleotide
  modified_base (17)..(17): methylated C nucleotide
  modified_base (25)..(25): methylated C nucleotide
  modified_base (30)..(30): methylated C nucleotide
  modified_base (33)..(33): methylated C nucleotide

SEQ ID NO: 1341 - DNA, 36 bp, Artificial Sequence
  Synthetic
  modified_base (8)..(8): methylated C nucleotide
  modified_base (11)..(11): methylated C nucleotide
  modified_base (13)..(13): methylated C nucleotide
  modified_base (18)..(18): methylated C nucleotide
  modified_base (26)..(26): methylated C nucleotide
  modified_base (31)..(31): methylated C nucleotide
  modified_base (34)..(34): methylated C nucleotide
agcctggcggcgcgagccgggcacccgggccgacga

SEQ ID NO: 1342 - DNA, 37 bp, Artificial Sequence
  Synthetic
  modified_base (9)..(9): methylated C nucleotide
  modified_base (12)..(12): methylated C nucleotide
  modified_base (14)..(14): methylated C nucleotide
  modified_base (19)..(19): methylated C nucleotide
  modified_base (27)..(27): methylated C nucleotide
  modified_base (32)..(32): methylated C nucleotide
  modified_base (35)..(35): methylated C nucleotide
gagcctggcggcgcgagccgggcacccgggccgacga

SEQ ID NO: 1343 - DNA, 38 bp, Artificial Sequence
  Synthetic
  modified_base (10)..(10): methylated C nucleotide
  modified_base (13)..(13): methylated C nucleotide
  modified_base (15)..(15): methylated C nucleotide
  modified_base (20)..(20): methylated C nucleotide
  modified_base (28)..(28): methylated C nucleotide
  modified_base (33)..(33): methylated C nucleotide
  modified_base (36)..(36): methylated C nucleotide
agagcctggcggcgcgagccgggcacccgggccgacga

SEQ ID NO: 1344 - DNA, 39 bp, Artificial Sequence
  Synthetic
  modified_base (11)..(11): methylated C nucleotide
  modified_base (14)..(14): methylated C nucleotide
  modified_base (16)..(16): methylated C nucleotide
  modified_base (21)..(21): methylated C nucleotide
  modified_base (29)..(29): methylated C nucleotide
  modified_base (34)..(34): methylated C nucleotide
  modified_base (37)..(37): methylated C nucleotide
cagagcctggcggcgcgagccgggcacccgggccgacga

SEQ ID NO: 1345 - DNA, 40 bp, Artificial Sequence
  Synthetic
  modified_base (12)..(12): methylated C nucleotide
  modified_base (15)..(15): methylated C nucleotide
  modified_base (17)..(17): methylated C nucleotide
  modified_base (22)..(22): methylated C nucleotide
  modified_base (30)..(30): methylated C nucleotide
  modified_base (35)..(35): methylated C nucleotide
  modified_base (38)..(38): methylated C nucleotide
ccagagcctggcggcgcgagccgggcacccgggccgacga

SEQ ID NO: 1346 - DNA, 36 bp, Artificial Sequence
  Synthetic
  modified_base (7)..(7): methylated C nucleotide
  modified_base (10)..(10): methylated C nucleotide
  modified_base (12)..(12): methylated C nucleotide
  modified_base (17)..(17): methylated C nucleotide
  modified_base (25)..(25): methylated C nucleotide
  modified_base (30)..(30): methylated C nucleotide
  modified_base (33)..(33): methylated C nucleotide
gcctggcggcgcgagccgggcacccgggccgacgaa

SEQ ID NO: 1347 - DNA, 37 bp, Artificial Sequence
  Synthetic
  modified_base (7)..(7): methylated C nucleotide
  modified_base (10)..(10): methylated C nucleotide
  modified_base (12)..(12): methylated C nucleotide
  modified_base (17)..(17): methylated C nucleotide
  modified_base (25)..(25): methylated C nucleotide
  modified_base (30)..(30): methylated C nucleotide
  modified_base (33)..(33): methylated C nucleotide
gcctggcggcgcgagccgggcacccgggccgacgaaa

SEQ ID NO: 1348 - DNA, 38 bp, Artificial Sequence
  Synthetic
  modified_base (7)..(7): methylated C nucleotide
  modified_base (10)..(10): methylated C nucleotide
  modified_base (12)..(12): methylated C nucleotide
  modified_base (17)..(17): methylated C nucleotide
  modified_base (25)..(25): methylated C nucleotide
  modified_base (30)..(30): methylated C nucleotide
  modified_base (33)..(33): methylated C nucleotide
gcctggcggcgcgagccgggcacccgggccgacgaaaa

SEQ ID NO: 1349 - DNA, 39 bp, Artificial Sequence
  Synthetic
  modified_base (7)..(7): methylated C nucleotide
  modified_base (10)..(10): methylated C nucleotide
  modified_base (12)..(12): methylated C nucleotide
  modified_base (17)..(17): methylated C nucleotide
  modified_base (25)..(25): methylated C nucleotide
  modified_base (30)..(30): methylated C nucleotide
  modified_base (33)..(33): methylated C nucleotide
gcctggcggcgcgagccgggcacccgggccgacgaaaag

SEQ ID NO: 1350 - DNA, 40 bp, Artificial Sequence
  Synthetic
  modified_base (7)..(7): methylated C nucleotide
  modified_base (10)..(10): methylated C nucleotide
  modified_base (12)..(12): methylated C nucleotide
  modified_base (17)..(17): methylated C nucleotide
  modified_base (25)..(25): methylated C nucleotide
  modified_base (30)..(30): methylated C nucleotide
  modified_base (33)..(33): methylated C nucleotide
gcctggcggcgcgagccgggcacccgggccgacgaaaagg

SEQ ID NO: 1351 - DNA, 37 bp, Artificial Sequence
  Synthetic
  modified_base (8)..(8): methylated  C nucleotide
  modified_base (11)..(11): methylated  C nucleotide
  modified_base (13)..(13): methylated  C nucleotide
  modified_base (18)..(18): methylated  C nucleotide
  modified_base (26)..(26): methylated  C nucleotide
  modified_base (31)..(31): methylated  C nucleotide
  modified_base (34)..(34): methylated  C nucleotide
agcctggcggcgcgagccgggcacccgggccgacgaa

SEQ ID NO: 1352 - DNA, 39 bp, Artificial Sequence
  Synthetic
  modified_base (9)..(9): methylated C nucleotide
  modified_base (12)..(12): methylated C nucleotide
  modified_base (14)..(14): methylated C nucleotide
  modified_base (19)..(19): methylated C nucleotide
  modified_base (27)..(27): methylated C nucleotide
  modified_base (32)..(32): methylated C nucleotide
  modified_base (35)..(35): methylated C nucleotide
gagcctggcggcgcgagccgggcacccgggccgacgaaa

SEQ ID NO: 1353 - DNA, 41 bp, Artificial Sequence
  Synthetic
  modified_base (10)..(10): methylated C nucleotide
  modified_base (13)..(13): methylated C nucleotide
  modified_base (15)..(15): methylated C nucleotide
  modified_base (20)..(20): methylated C nucleotide
  modified_base (28)..(28): methylated C nucleotide
  modified_base (33)..(33): methylated C nucleotide
  modified_base (36)..(36): methylated C nucleotide
agagcctggcggcgcgagccgggcacccgggccgacgaaaa

SEQ ID NO: 1354 - DNA, 43 bp, Artificial Sequence
  Synthetic
  modified_base (11)..(11): methylated C nucleotide
  modified_base (14)..(14): methylated C nucleotide
  modified_base (16)..(16): methylated C nucleotide
  modified_base (21)..(21): methylated C nucleotide
  modified_base (29)..(29): methylated C nucleotide
  modified_base (34)..(34): methylated C nucleotide
  modified_base (37)..(37): methylated C nucleotide
cagagcctggcggcgcgagccgggcacccgggccgacgaaaag

SEQ ID NO: 1355 - DNA, 45 bp, Artificial Sequence
  Synthetic
  modified_base (12)..(12): methylated C nucleotide
  modified_base (15)..(15): methylated C nucleotide
  modified_base (17)..(17): methylated C nucleotide
  modified_base (22)..(22): methylated C nucleotide
  modified_base (30)..(30): methylated C nucleotide
  modified_base (35)..(35): methylated C nucleotide
  modified_base (38)..(38): methylated C nucleotide
ccagagcctggcggcgcgagccgggcacccgggccgacgaaaagg

SEQ ID NO: 1356 - DNA, 35 bp, Artificial Sequence
  Synthetic
  modified_base (10)..(10): methylated C nucleotide
  modified_base (13)..(13): methylated C nucleotide
  modified_base (15)..(15): methylated C nucleotide
  modified_base (20)..(20): methylated C nucleotide
  modified_base (28)..(28): methylated C nucleotide
  modified_base (33)..(33): methylated C nucleotide
agagcctggcggcgcgagccgggcacccgggccga

SEQ ID NO: 1357 - DNA, 35 bp, Artificial Sequence
  Synthetic
  modified_base (13)..(13): methylated C nucleotide
  modified_base (16)..(16): methylated C nucleotide
  modified_base (18)..(18): methylated C nucleotide
  modified_base (23)..(23): methylated C nucleotide
  modified_base (31)..(31): methylated C nucleotide
cccagagcctggcggcgcgagccgggcacccgggc

SEQ ID NO: 1358 - DNA, 35 bp, Artificial Sequence
  Synthetic
  modified_base (16)..(16): methylated C nucleotide
  modified_base (19)..(19): methylated C nucleotide
  modified_base (21)..(21): methylated C nucleotide
  modified_base (26)..(26): methylated C nucleotide
  modified_base (34)..(34): methylated C nucleotide
gatcccagagcctggcggcgcgagccgggcacccg

SEQ ID NO: 1359 - DNA, 35 bp, Artificial Sequence
  Synthetic
  modified_base (19)..(19): methylated C nucleotide
  modified_base (22)..(22): methylated C nucleotide
  modified_base (24)..(24): methylated C nucleotide
  modified_base (29)..(29): methylated C nucleotide
tgggatcccagagcctggcggcgcgagccgggcac

SEQ ID NO: 1360 - DNA, 35 bp, Artificial Sequence
  Synthetic
  modified_base (22)..(22): methylated C nucleotide
  modified_base (25)..(25): methylated C nucleotide
  modified_base (27)..(27): methylated C nucleotide
  modified_base (32)..(32): methylated C nucleotide
acctgggatcccagagcctggcggcgcgagccggg

SEQ ID NO: 1361 - DNA, 35 bp, Artificial Sequence
  Synthetic
  modified_base (4)..(4): methylated C nucleotide
  modified_base (7)..(7): methylated C nucleotide
  modified_base (9)..(9): methylated C nucleotide
  modified_base (14)..(14): methylated C nucleotide
  modified_base (22)..(22): methylated C nucleotide
  modified_base (27)..(27): methylated C nucleotide
  modified_base (30)..(30): methylated C nucleotide
tggcggcgcgagccgggcacccgggccgacgaaaa

SEQ ID NO: 1362 - DNA, 35 bp, Artificial Sequence
  Synthetic
  modified_base (1)..(1): methylated C nucleotide
  modified_base (4)..(4): methylated C nucleotide
  modified_base (6)..(6): methylated C nucleotide
  modified_base (11)..(11): methylated C nucleotide
  modified_base (19)..(19): methylated C nucleotide
  modified_base (24)..(24): methylated C nucleotide
  modified_base (27)..(27): methylated C nucleotide
cggcgcgagccgggcacccgggccgacgaaaaggc

SEQ ID NO: 1363 - DNA, 35 bp, Artificial Sequence
  Synthetic
  modified_base (1)..(1): methylated C nucleotide
  modified_base (3)..(3): methylated C nucleotide
  modified_base (8)..(8): methylated C nucleotide
  modified_base (16)..(16): methylated C nucleotide
  modified_base (21)..(21): methylated C nucleotide
  modified_base (24)..(24): methylated C nucleotide
cgcgagccgggcacccgggccgacgaaaaggcagg

SEQ ID NO: 1364 - DNA, 35 bp, Artificial Sequence
  Synthetic
  modified_base (5)..(5): methylated C nucleotide
  modified_base (13)..(13): methylated C nucleotide
  modified_base (18)..(18): methylated C nucleotide
  modified_base (21)..(21): methylated C nucleotide
gagccgggcacccgggccgacgaaaaggcaggaag

SEQ ID NO: 1365 - DNA, 35 bp, Artificial Sequence
  Synthetic
  modified_base (2)..(2): methylated C nucleotide
  modified_base (10)..(10): methylated C nucleotide
  modified_base (15)..(15): methylated C nucleotide
  modified_base (18)..(18): methylated C nucleotide
ccgggcacccgggccgacgaaaaggcaggaagcgc

SEQ ID NO: 1366 - DNA, 33 bp, Artificial Sequence
  Synthetic
  modified_base (5)..(5): methylated C nucleotide
  modified_base (8)..(8): methylated C nucleotide
  modified_base (10)..(10): methylated C nucleotide
  modified_base (15)..(15): methylated C nucleotide
  modified_base (23)..(23): methylated C nucleotide
  modified_base (28)..(28): methylated C nucleotide
  modified_base (31)..(31): methylated C nucleotide
ctggcggcgcgagccgggcacccgggccgacga

SEQ ID NO: 1367 - DNA, 31 bp, Artificial Sequence
  Synthetic
  modified_base (3)..(3): methylated C nucleotide
  modified_base (6)..(6): methylated C nucleotide
  modified_base (8)..(8): methylated C nucleotide
  modified_base (13)..(13): methylated C nucleotide
  modified_base (21)..(21): methylated C nucleotide
  modified_base (26)..(26): methylated C nucleotide
  modified_base (29)..(29): methylated C nucleotide
ggcggcgcgagccgggcacccgggccgacga

SEQ ID NO: 1368 - DNA, 29 bp, Artificial Sequence
  Synthetic
  modified_base (1)..(1): methylated C nucleotide
  modified_base (4)..(4): methylated C nucleotide
  modified_base (6)..(6): methylated C nucleotide
  modified_base (11)..(11): methylated C nucleotide
  modified_base (19)..(19): methylated C nucleotide
  modified_base (24)..(24): methylated C nucleotide
  modified_base (27)..(27): methylated C nucleotide
cggcgcgagccgggcacccgggccgacga

SEQ ID NO: 1369 - DNA, 27 bp, Artificial Sequence
  Synthetic
  modified_base (2)..(2): methylated C nucleotide
  modified_base (4)..(4): methylated C nucleotide
  modified_base (9)..(9): methylated C nucleotide
  modified_base (17)..(17): methylated C nucleotide
  modified_base (22)..(22): methylated C nucleotide
  modified_base (25)..(25): methylated C nucleotide
gcgcgagccgggcacccgggccgacga

SEQ ID NO: 1370 - DNA, 25 bp, Artificial Sequence
  Synthetic
  modified_base (2)..(2): methylated C nucleotide
  modified_base (7)..(7): methylated C nucleotide
  modified_base (15)..(15): methylated C nucleotide
  modified_base (20)..(20): methylated C nucleotide
  modified_base (23)..(23): methylated C nucleotide
gcgagccgggcacccgggccgacga

SEQ ID NO: 1371 - DNA, 23 bp, Artificial Sequence
  Synthetic
  modified_base (5)..(5): methylated C nucleotide
  modified_base (13)..(13): methylated C nucleotide
  modified_base (18)..(18): methylated C nucleotide
  modified_base (21)..(21): methylated C nucleotide
gagccgggcacccgggccgacga

SEQ ID NO: 1372 - DNA, 21 bp, Artificial Sequence
  Synthetic
  modified_base (3)..(3): methylated C nucleotide
  modified_base (11)..(11): methylated C nucleotide
  modified_base (16)..(16): methylated C nucleotide
  modified_base (19)..(19): methylated C nucleotide
gccgggcacccgggccgacga

SEQ ID NO: 1373 - DNA, 19 bp, Artificial Sequence
  Synthetic
  modified_base (1)..(1): methylated C nucleotide
  modified_base (9)..(9): methylated C nucleotide
  modified_base (14)..(14): methylated C nucleotide
  modified_base (17)..(17): methylated C nucleotide
cgggcacccgggccgacga

SEQ ID NO: 1374 - DNA, 17 bp, Artificial Sequence
  Synthetic
  modified_base (7)..(7): methylated C nucleotide
  modified_base (12)..(12): methylated C nucleotide
  modified_base (15)..(15): methylated C nucleotide
ggcacccgggccgacga

SEQ ID NO: 1375 - DNA, 15 bp, Artificial Sequence
  Synthetic
  modified_base (5)..(5): methylated C nucleotide
  modified_base (10)..(10): methylated C nucleotide
  modified_base (13)..(13): methylated C nucleotide
cacccgggccgacga

SEQ ID NO: 1376 - DNA, 33 bp, Artificial Sequence
  Synthetic
  modified_base (7)..(7): methylated C nucleotide
  modified_base (10)..(10): methylated C nucleotide
  modified_base (12)..(12): methylated C nucleotide
  modified_base (17)..(17): methylated C nucleotide
  modified_base (25)..(25): methylated C nucleotide
  modified_base (30)..(30): methylated C nucleotide
  modified_base (33)..(33): methylated C nucleotide
gcctggcggcgcgagccgggcacccgggccgac

SEQ ID NO: 1377 - DNA, 31 bp, Artificial Sequence
  Synthetic
  modified_base (7)..(7): methylated C nucleotide
  modified_base (10)..(10): methylated C nucleotide
  modified_base (12)..(12): methylated C nucleotide
  modified_base (17)..(17): methylated C nucleotide
  modified_base (25)..(25): methylated C nucleotide
  modified_base (30)..(30): methylated C nucleotide
gcctggcggcgcgagccgggcacccgggccg

SEQ ID NO: 1378 - DNA, 29 bp, Artificial Sequence
  Synthetic
  modified_base (7)..(7): methylated C nucleotide
  modified_base (10)..(10): methylated C nucleotide
  modified_base (12)..(12): methylated C nucleotide
  modified_base (17)..(17): methylated C nucleotide
  modified_base (25)..(25): methylated C nucleotide
gcctggcggcgcgagccgggcacccgggc

SEQ ID NO: 1379 - DNA, 27 bp, Artificial Sequence
  Synthetic
  modified_base (7)..(7): methylated C nucleotide
  modified_base (10)..(10): methylated C nucleotide
  modified_base (12)..(12): methylated C nucleotide
  modified_base (17)..(17): methylated C nucleotide
  modified_base (25)..(25): methylated C nucleotide
gcctggcggcgcgagccgggcacccgg

SEQ ID NO: 1380 - DNA, 25 bp, Artificial Sequence
  Synthetic
  modified_base (7)..(7): methylated C nucleotide
  modified_base (10)..(10): methylated C nucleotide
  modified_base (12)..(12): methylated C nucleotide
  modified_base (17)..(17): methylated C nucleotide
  modified_base (25)..(25): methylated C nucleotide
gcctggcggcgcgagccgggcaccc

SEQ ID NO: 1381 - DNA, 23 bp, Artificial Sequence
  Synthetic
  modified_base (7)..(7): methylated C nucleotide
  modified_base (10)..(10): methylated C nucleotide
  modified_base (12)..(12): methylated C nucleotide
  modified_base (17)..(17): methylated C nucleotide
gcctggcggcgcgagccgggcac

SEQ ID NO: 1382 - DNA, 21 bp, Artificial Sequence
  Synthetic
  modified_base (7)..(7): methylated C nucleotide
  modified_base (10)..(10): methylated C nucleotide
  modified_base (12)..(12): methylated C nucleotide
  modified_base (17)..(17): methylated C nucleotide
gcctggcggcgcgagccgggc

SEQ ID NO: 1383 - DNA, 19 bp, Artificial Sequence
  Synthetic
  modified_base (7)..(7): methylated C nucleotide
  modified_base (10)..(10): methylated C nucleotide
  modified_base (12)..(12): methylated C nucleotide
  modified_base (17)..(17): methylated C nucleotide
gcctggcggcgcgagccgg

SEQ ID NO: 1384 - DNA, 17 bp, Artificial Sequence
  Synthetic
  modified_base (7)..(7): methylated C nucleotide
  modified_base (10)..(10): methylated C nucleotide
  modified_base (12)..(12): methylated C nucleotide
  modified_base (17)..(17): methylated C nucleotide
gcctggcggcgcgagcc

SEQ ID NO: 1385 - DNA, 15 bp, Artificial Sequence
  Synthetic
  modified_base (7)..(7): methylated C nucleotide
  modified_base (10)..(10): methylated C nucleotide
  modified_base (12)..(12): methylated C nucleotide
gcctggcggcgcgag

SEQ ID NO: 1386 - DNA, 35 bp, Artificial Sequence
  Synthetic
  modified_base (7)..(7): methylated C nucleotide
  modified_base (10)..(10): methylated C nucleotide
  modified_base (12)..(12): methylated C nucleotide
  modified_base (17)..(17): methylated C nucleotide
  modified_base (25)..(25): methylated C nucleotide
  modified_base (30)..(30): methylated C nucleotide
  modified_base (33)..(33): methylated C nucleotide
gcctggcggcgcgagccaggcacccgggccgacga

SEQ ID NO: 1387 - DNA, 35 bp, Artificial Sequence
  Synthetic
  modified_base (7)..(7): methylated C nucleotide
  modified_base (10)..(10): methylated C nucleotide
  modified_base (12)..(12): methylated C nucleotide
  modified_base (17)..(17): methylated C nucleotide
  modified_base (25)..(25): methylated C nucleotide
  modified_base (30)..(30): methylated C nucleotide
  modified_base (33)..(33): methylated C nucleotide
gcctggcgccgcgagccgggcacccgggccgacga

SEQ ID NO: 1388 - DNA, 35 bp, Artificial Sequence
  Synthetic
  modified_base (7)..(7): methylated C nucleotide
  modified_base (10)..(10): methylated C nucleotide
  modified_base (12)..(12): methylated C nucleotide
  modified_base (17)..(17): methylated C nucleotide
  modified_base (25)..(25): methylated C nucleotide
  modified_base (30)..(30): methylated C nucleotide
  modified_base (33)..(33): methylated C nucleotide
gcctggcggcgcgagccgggcacccgggcctacga

SEQ ID NO: 1389 - DNA, 33 bp, Artificial Sequence; identical to SEQ ID NO: 139
  Synthetic
  modified_base (4)..(4): methylated C nucleotide
  modified_base (9)..(9): methylated C nucleotide
  modified_base (31)..(31): methylated C nucleotide

SEQ ID NO: 1390 - DNA, 34 bp, Artificial Sequence
  Synthetic
  modified_base (5)..(5): methylated C nucleotide
  modified_base (10)..(10): methylated C nucleotide
  modified_base (32)..(32): methylated C nucleotide
tgggcggggcgacctgggatcccaggcctggcgg

SEQ ID NO: 1391 - DNA, 35 bp, Artificial Sequence
  Synthetic
  modified_base (6)..(6): methylated C nucleotide
  modified_base (11)..(11): methylated C nucleotide
  modified_base (33)..(33): methylated C nucleotide
ctgggcggggcgacctgggatcccaggcctggcgg

SEQ ID NO: 1392 - DNA, 36 bp, Artificial Sequence
  Synthetic
  modified_base (7)..(7): methylated C nucleotide
  modified_base (12)..(12): methylated C nucleotide
  modified_base (34)..(34): methylated C nucleotide
gctgggcggggcgacctgggatcccaggcctggcgg

SEQ ID NO: 1393 - DNA, 37 bp, Artificial Sequence
  Synthetic
  modified_base (8)..(8): methylated C nucleotide
  modified_base (13)..(13): methylated C nucleotide
  modified_base (35)..(35): methylated C nucleotide
tgctgggcggggcgacctgggatcccaggcctggcgg

SEQ ID NO: 1394 - DNA, 38 bp, Artificial Sequence
  Synthetic
  modified_base (9)..(9): methylated C nucleotide
  modified_base (14)..(14): methylated C nucleotide
  modified_base (36)..(36): methylated C nucleotide
ctgctgggcggggcgacctgggatcccaggcctggcgg

SEQ ID NO: 1395 - DNA, 34 bp, Artificial Sequence
  Synthetic
  modified_base (4)..(4): methylated C nucleotide
  modified_base (9)..(9): methylated C nucleotide
  modified_base (31)..(31): methylated C nucleotide
gggcggggcgacctgggatcccaggcctggcggc

SEQ ID NO: 1396 - DNA, 35 bp, Artificial Sequence
  Synthetic
  modified_base (4)..(4): methylated C nucleotide
  modified_base (9)..(9): methylated C nucleotide
  modified_base (31)..(31): methylated C nucleotide
gggcggggcgacctgggatcccaggcctggcggcg

SEQ ID NO: 1397 - DNA, 36 bp, Artificial Sequence
  Synthetic
  modified_base (4)..(4): methylated C nucleotide
  modified_base (9)..(9): methylated C nucleotide
  modified_base (31)..(31): methylated C nucleotide
gggcggggcgacctgggatcccaggcctggcggcgc

SEQ ID NO: 1398 - DNA, 37 bp, Artificial Sequence
  Synthetic
  modified_base (4)..(4): methylated C nucleotide
  modified_base (9)..(9): methylated C nucleotide
  modified_base (31)..(31): methylated C nucleotide
gggcggggcgacctgggatcccaggcctggcggcgcg

SEQ ID NO: 1399 - DNA, 38 bp, Artificial Sequence
  Synthetic
  modified_base (4)..(4): methylated C nucleotide
  modified_base (9)..(9): methylated C nucleotide
  modified_base (31)..(31): methylated C nucleotide
gggcggggcgacctgggatcccaggcctggcggcgcga

SEQ ID NO: 1400 - DNA, 35 bp, Artificial Sequence
  Synthetic
  modified_base (5)..(5): methylated C nucleotide
  modified_base (10)..(10): methylated C nucleotide
  modified_base (32)..(32): methylated C nucleotide
tgggcggggcgacctgggatcccaggcctggcggc

SEQ ID NO: 1401 - DNA, 37 bp, Artificial Sequence
  Synthetic
  modified_base (6)..(6): methylated C nucleotide
  modified_base (11)..(11): methylated C nucleotide
  modified_base (33)..(33): methylated C nucleotide
ctgggcggggcgacctgggatcccaggcctggcggcg

SEQ ID NO: 1402 - DNA, 39 bp, Artificial Sequence
  Synthetic
  modified_base (7)..(7): methylated C nucleotide
  modified_base (12)..(12): methylated C nucleotide
  modified_base (34)..(34): methylated C nucleotide
gctgggcggggcgacctgggatcccaggcctggcggcgc

SEQ ID NO: 1403 - DNA, 41 bp, Artificial Sequence
  Synthetic
  modified_base (8)..(8): methylated C nucleotide
  modified_base (13)..(13): methylated C nucleotide
  modified_base (35)..(35): methylated C nucleotide
tgctgggcggggcgacctgggatcccaggcctggcggcgcg

SEQ ID NO: 1404 - DNA, 43 bp, Artificial Sequence
  Synthetic
  modified_base (9)..(9): methylated C nucleotide
  modified_base (14)..(14): methylated C nucleotide
  modified_base (36)..(36): methylated C nucleotide
ctgctgggcggggcgacctgggatcccaggcctggcggcgcga

SEQ ID NO: 1405 - DNA, 33 bp, Artificial Sequence
  Synthetic
  modified_base (7)..(7): methylated C nucleotide
  modified_base (12)..(12): methylated C nucleotide
gctgggcggggcgacctgggatcccaggcctgg

SEQ ID NO: 1406 - DNA, 33 bp, Artificial Sequence
  Synthetic
  modified_base (10)..(10): methylated C nucleotide
  modified_base (15)..(15): methylated C nucleotide
gctgctgggcggggcgacctgggatcccaggcc

SEQ ID NO: 1407 - DNA, 33 bp, Artificial Sequence
  Synthetic
  modified_base (13)..(13): methylated C nucleotide
  modified_base (18)..(18): methylated C nucleotide
cgggctgctgggcggggcgacctgggatcccag

SEQ ID NO: 1408 - DNA, 34 bp, Artificial Sequence
  Synthetic
  modified_base (16)..(16): methylated C nucleotide
  modified_base (21)..(21): methylated C nucleotide
gcgcgggctgctgggcggggcgacctgggatccc

SEQ ID NO: 1409 - DNA, 34 bp, Artificial Sequence
  Synthetic
  modified_base (19)..(19): methylated C nucleotide
  modified_base (24)..(24): methylated C nucleotide
agggcgcgggctgctgggcggggcgacctgggat

SEQ ID NO: 1410 - DNA, 33 bp, Artificial Sequence
  Synthetic
  modified_base (1)..(1): methylated C nucleotide
  modified_base (6)..(6): methylated C nucleotide
  modified_base (28)..(28): methylated C nucleotide
cggggcgacctgggatcccaggcctggcggcgc

SEQ ID NO: 1411 - DNA, 33 bp, Artificial Sequence
  Synthetic
  modified_base (3)..(3): methylated C nucleotide
  modified_base (25)..(25): methylated C nucleotide
ggcgacctgggatcccaggcctggcggcgcgag

SEQ ID NO: 1412 - DNA, 33 bp, Artificial Sequence
  Synthetic
  modified_base (22)..(22): methylated C nucleotide
gacctgggatcccaggcctggcggcgcgagccg

SEQ ID NO: 1413 - DNA, 33 bp, Artificial Sequence
  Synthetic
  modified_base (19)..(19): methylated C nucleotide
ctgggatcccaggcctggcggcgcgagccgggc

SEQ ID NO: 1414 - DNA, 33 bp, Artificial Sequence
  Synthetic
  modified_base (16)..(16): methylated C nucleotide
ggatcccaggcctggcggcgcgagccgggcacc

SEQ ID NO: 1415 - DNA, 31 bp, Artificial Sequence
  Synthetic
  modified_base (2)..(2): methylated C nucleotide
  modified_base (7)..(7): methylated C nucleotide
  modified_base (29)..(29): methylated C nucleotide
gcggggcgacctgggatcccaggcctggcgg

SEQ ID NO: 1416 - DNA, 29 bp, Artificial Sequence
  Synthetic
  modified_base (5)..(5): methylated C nucleotide
  modified_base (27)..(27): methylated C nucleotide
ggggcgacctgggatcccaggcctggcgg

SEQ ID NO: 1417 - DNA, 27 bp, Artificial Sequence
  Synthetic
  modified_base (3)..(3): methylated C nucleotide
  modified_base (25)..(25): methylated C nucleotide
ggcgacctgggatcccaggcctggcgg

SEQ ID NO: 1418 - DNA, 25 bp, Artificial Sequence
  Synthetic
  modified_base (1)..(1): methylated C nucleotide
  modified_base (23)..(23): methylated C nucleotide
cgacctgggatcccaggcctggcgg

SEQ ID NO: 1419 - DNA, 23 bp, Artificial Sequence
  Synthetic
  modified_base (21)..(21): methylated C nucleotide
acctgggatcccaggcctggcgg

SEQ ID NO: 1420 - DNA, 21 bp, Artificial Sequence
  Synthetic
  modified_base (19)..(19): methylated C nucleotide
ctgggatcccaggcctggcgg

SEQ ID NO: 1421 - DNA, 19 bp, Artificial Sequence
  Synthetic
  modified_base (17)..(17): methylated C nucleotide
gggatcccaggcctggcgg

SEQ ID NO: 1422 - DNA, 17 bp, Artificial Sequence
  Synthetic
  modified_base (15)..(15): methylated C nucleotide
gatcccaggcctggcgg

SEQ ID NO: 1423 - DNA, 15 bp, Artificial Sequence
  Synthetic
  modified_base (13)..(13): methylated C nucleotide
tcccaggcctggcgg

SEQ ID NO: 1424 - DNA, 14 bp, Artificial Sequence
  Synthetic
  modified_base (12)..(12): methylated C nucleotide
cccaggcctggcgg

SEQ ID NO: 1425 - DNA, 31 bp, Artificial Sequence
  Synthetic
  modified_base (4)..(4): methylated C nucleotide
  modified_base (9)..(9): methylated C nucleotide
  modified_base (31)..(31): methylated C nucleotide
gggcggggcgacctgggatcccaggcctggc

SEQ ID NO: 1426 - DNA, 29 bp, Artificial Sequence
  Synthetic
  modified_base (4)..(4): methylated C nucleotide
  modified_base (9)..(9): methylated C nucleotide
gggcggggcgacctgggatcccaggcctg

SEQ ID NO: 1427 - DNA, 27 bp, Artificial Sequence
  Synthetic
  modified_base (4)..(4): methylated C nucleotide
  modified_base (9)..(9): methylated C nucleotide
gggcggggcgacctgggatcccaggcc

SEQ ID NO: 1428 - DNA, 25 bp, Artificial Sequence
  Synthetic
  modified_base (4)..(4): methylated C nucleotide
  modified_base (9)..(9): methylated C nucleotide
gggcggggcgacctgggatcccagg

SEQ ID NO: 1429 - DNA, 24 bp, Artificial Sequence
  Synthetic
  modified_base (4)..(4): methylated C nucleotide
  modified_base (9)..(9): methylated C nucleotide
gggcggggcgacctgggatcccag

SEQ ID NO: 1430 - DNA, 22 bp, Artificial Sequence
  Synthetic
  modified_base (4)..(4): methylated C nucleotide
  modified_base (9)..(9): methylated C nucleotide
gggcggggcgacctgggatccc

SEQ ID NO: 1431 - DNA, 20 bp, Artificial Sequence
  Synthetic
  modified_base (4)..(4): methylated C nucleotide
  modified_base (9)..(9): methylated C nucleotide
gggcggggcgacctgggatc

SEQ ID NO: 1432 - DNA, 18 bp, Artificial Sequence
  Synthetic
  modified_base (4)..(4): methylated C nucleotide
  modified_base (9)..(9): methylated C nucleotide
gggcggggcgacctggga

SEQ ID NO: 1433 - DNA, 16 bp, Artificial Sequence
  Synthetic
  modified_base (4)..(4): methylated C nucleotide
  modified_base (9)..(9): methylated C nucleotide
gggcggggcgacctgg

SEQ ID NO: 1434 - DNA, 15 bp, Artificial Sequence
  Synthetic
  modified_base (4)..(4): methylated C nucleotide
  modified_base (9)..(9): methylated C nucleotide
gggcggggcgacctg

SEQ ID NO: 1435 - DNA, 33 bp, Artificial Sequence
  Synthetic
  modified_base (4)..(4): methylated C nucleotide
  modified_base (9)..(9): methylated C nucleotide
  modified_base (31)..(31): methylated C nucleotide
gggcggggcgacctggcatcccaggcctggcgg

SEQ ID NO: 1436 - DNA, 33 bp, Artificial Sequence
  Synthetic
  modified_base (4)..(4): methylated C nucleotide
  modified_base (9)..(9): methylated C nucleotide
  modified_base (31)..(31): methylated C nucleotide
gggcggggcgatctgggatcccaggcctggcgg

SEQ ID NO: 1437 - DNA, 33 bp, Artificial Sequence
  Synthetic
  modified_base (4)..(4): methylated C nucleotide
  modified_base (9)..(9): methylated C nucleotide
  modified_base (31)..(31): methylated C nucleotide
gggcggggcgacctgggatcccaggcctgccgg

SEQ ID NO: 1438 - DNA, 24 bp, Artificial Sequence
  Synthetic
  modified_base (3)..(3): methylated C nucleotide
  modified_base (7)..(7): methylated C nucleotide
  modified_base (9)..(9): methylated C nucleotide
  modified_base (17)..(17): methylated C nucleotide
  modified_base (21)..(21): methylated C nucleotide
cacgcacgcgcatccccgcccgtg

SEQ ID NO: 1439 - DNA, 24 bp, Artificial Sequence
  Synthetic
cacgcacgcgcatccccgcccgtg

We claim:

1. A pharmaceutical composition comprising an oligonucleotide consisting of SEQ ID NO:112.

2. A pharmaceutical composition comprising an oligonucleotide consisting of SEQ ID NO:112, wherein all cytosine bases in said oligonucleotide are 5-methylcytosine.

3. A pharmaceutical composition comprising an oligonucleotide consisting of SEQ ID NO:112, wherein no cytosine base in said oligonucleotide is methylated.

4. A pharmaceutical composition wherein at least one of the cytosine bases in said oligonucleotide is methylated.

5. An oligonucleotide consisting of SEQ ID NO:112.

6. An oligonucleotide consisting of SEQ ID NO:112, wherein no cytosine base in said oligonucleotide is methylated.

7. A pharmaceutical composition comprising an oligonucloetide consisting of SEQ ID NO:112 with a pharmaceutically acceptable carrier.

8. A pharmaceutical composition comprising an oligonucleotide consisting of SEQ ID NO:112, wherein no cytosine base is methylated, with a pharmaceutically acceptable carrier.

* * * * *